US011857622B2

(12) United States Patent
Liu et al.

(10) Patent No.: US 11,857,622 B2
(45) Date of Patent: Jan. 2, 2024

(54) HUMAN CYTOMEGALOVIRUS GB POLYPEPTIDE

(71) Applicant: Pfizer Inc., New York, NY (US)

(72) Inventors: Yuhang Liu, South Glastonbury, CT (US); Ye Che, Niantic, CT (US); Xiaoyuan Sherry Chi, Tenafly, NJ (US); Philip Ralph Dormitzer, Nyack, NY (US); Jennifer Anne Nicki, Gales Ferry, CT (US); Xiaojie Yao, East Lyme, CT (US)

(73) Assignee: Pfizer Inc., New York, NY (US)

( * ) Notice: Subject to any disclaimer, the term of this patent is extended or adjusted under 35 U.S.C. 154(b) by 0 days.

(21) Appl. No.: 17/350,008

(22) Filed: Jun. 17, 2021

(65) Prior Publication Data

US 2022/0088184 A1    Mar. 24, 2022

Related U.S. Application Data

(60) Provisional application No. 63/208,457, filed on Jun. 8, 2021, provisional application No. 63/041,945, filed on Jun. 21, 2020.

(51) Int. Cl.
*A61K 39/245* (2006.01)
*C07K 14/045* (2006.01)
*C12N 7/00* (2006.01)

(52) U.S. Cl.
CPC .......... *A61K 39/245* (2013.01); *C07K 14/045* (2013.01); *C12N 7/00* (2013.01); *C12N 2710/16134* (2013.01)

(58) Field of Classification Search
CPC .... A61K 39/245; A61K 39/12; C07K 14/045; C07K 14/005; C12N 7/00; C12N 2710/16134; C12N 2710/16122; A61P 31/22
See application file for complete search history.

(56) References Cited

U.S. PATENT DOCUMENTS

| | | |
|---|---|---|
| 5,244,805 A | 9/1993 | Miller |
| 6,015,565 A | 1/1999 | Rose et al. |
| 8,716,257 B2 | 5/2014 | Cobbs et al. |
| 9,683,022 B2 | 6/2017 | Carfi et al. |
| 10,611,800 B2 | 4/2020 | Yang et al. |
| 2002/0076813 A1 | 6/2002 | Steaffens et al. |
| 2011/0200633 A1 | 8/2011 | Shenk et al. |
| 2015/0359879 A1 | 12/2015 | Wellnitz et al. |
| 2018/0265551 A1 | 9/2018 | Carfi et al. |
| 2019/0127422 A1 | 5/2019 | Yang et al. |
| 2019/0314493 A1 | 10/2019 | Ciaramella et al. |
| 2020/0247853 A1* | 8/2020 | Dormitzer .............. A61K 39/12 |
| 2021/0346494 A1 | 11/2021 | Torikai et al. |

FOREIGN PATENT DOCUMENTS

| | | |
|---|---|---|
| EP | 3031822 A1 | 6/2016 |
| WO | 89/07143 A1 | 8/1989 |
| WO | 91/15586 A1 | 10/1991 |
| WO | 94/00150 A1 | 1/1994 |
| WO | 94/03620 A2 | 2/1994 |
| WO | 94/17810 A1 | 8/1994 |
| WO | 95/26751 A1 | 10/1995 |
| WO | 95/28941 A1 | 11/1995 |
| WO | 95/31555 A1 | 11/1995 |
| WO | 95/32213 A1 | 11/1995 |
| WO | 96/04383 A1 | 2/1996 |
| WO | 96/04384 A1 | 2/1996 |
| WO | 96/39491 A1 | 12/1996 |
| WO | 97/05262 A1 | 2/1997 |
| WO | 97/12042 A2 | 4/1997 |
| WO | 97/31117 A2 | 8/1997 |
| WO | 97/33992 A1 | 9/1997 |
| WO | 97/40165 A1 | 10/1997 |
| WO | 98/02746 A1 | 1/1998 |
| WO | 98/21233 A2 | 5/1998 |
| WO | 98/26074 A1 | 6/1998 |
| WO | 98/45314 A1 | 10/1998 |
| WO | 99/13075 A2 | 3/1999 |
| WO | 99/19349 A1 | 4/1999 |
| WO | 00/53729 A2 | 9/2000 |
| WO | 00/75180 A2 | 12/2000 |
| WO | 01/16153 A1 | 3/2001 |
| WO | 01/72782 A2 | 10/2001 |
| WO | 02/18954 A2 | 3/2002 |
| WO | 02/34769 A2 | 5/2002 |
| WO | 02/062296 A2 | 8/2002 |

(Continued)

OTHER PUBLICATIONS

Vitu E, Sharma S, Stampfer SD, Heldwein EE. Extensive mutagenesis of the HSV-1 gB ectodomain reveals remarkable stability of its postfusion form. J Mol Biol. Jun. 12, 2013;425(11):2056-2071. Epub Mar. 13, 2013. (Year: 2013).*
Joyce MG, Zhang B, Ou L, Chen M, Chuang GY, Druz A, Kong WP, Lai YT, Rundiet EJ, Tsybovsky Y, Yang Y, Georgiev IS, Guttman M, Lees CR, Pancera M, et. al. Iterative structure-based improvement of a fusion-glycoprotein vaccine against RSV. Nat Struct Mol Biol. Sep. 2016;23(9):811-820. Epub Aug. 1, 2016. (Year: 2016).*
Cranage MP, et. al. RecName: Full=Envelope glycoprotein B; Short=gB; Flags: Precursor. UniProtKB/Swiss-Prot: P06473.1, Human Herpesvirus 5 Strain AD169. Dep. Apr. 24, 1992. (Year: 1992).*
Davison AJ. envelope glycoprotein B [Human betaherpesvirus 5], GenBank: ACS91991.1. Dep. May 9, 2013. (Year: 2013).*
Nelson CS, et al. Glycoprotein B [Human betaherpesvirus 5], GenBank: AZB53158.1. Dep. Dec. 3, 2018. (Year: 2018).*

(Continued)

*Primary Examiner* — Rachel B Gill
(74) *Attorney, Agent, or Firm* — Rebecca Wright

(57) ABSTRACT

The present invention comprises mutants of a wild-type cytomegalovirus (CMV) glycoprotein B (gB) protein that include at least two introduced amino acid mutations relative to the amino acid sequence of the wild-type HCMV glycoprotein B (gB), compositions including the mutants and uses thereof. In some embodiments, the mutant is stabilized in a conformation alternative to the gB postfusion conformation.

37 Claims, 79 Drawing Sheets

Specification includes a Sequence Listing.

(56) References Cited

FOREIGN PATENT DOCUMENTS

| | | |
|---|---|---|
| WO | 02/062956 A2 | 8/2002 |
| WO | 02/066629 A2 | 8/2002 |
| WO | 03/000720 A1 | 1/2003 |
| WO | 03/035835 A2 | 5/2003 |
| WO | 2004/000873 A2 | 12/2003 |
| WO | 2004/055166 A2 | 7/2004 |
| WO | 2004/058166 A2 | 7/2004 |
| WO | 2004/076645 A2 | 9/2004 |
| WO | 2004/093905 A1 | 11/2004 |
| WO | 2004/111080 A1 | 12/2004 |
| WO | 2005/007689 A1 | 1/2005 |
| WO | 2005/012545 A2 | 2/2005 |
| WO | 2005/035771 A2 | 4/2005 |
| WO | 2005/085456 A1 | 9/2005 |
| WO | 2006/004661 A1 | 1/2006 |
| WO | 2006/056027 A1 | 6/2006 |
| WO | 2006/110728 A2 | 10/2006 |
| WO | 2007/054250 A1 | 5/2007 |
| WO | 2007/062832 A2 | 6/2007 |
| WO | 2007/068758 A1 | 6/2007 |
| WO | 2007/068907 A2 | 6/2007 |
| WO | 2007/106404 A2 | 9/2007 |
| WO | 2007/130470 A2 | 11/2007 |
| WO | 2007/146024 A2 | 12/2007 |
| WO | 2008/003327 A2 | 1/2008 |
| WO | 2008/071806 A1 | 6/2008 |
| WO | 2008/084410 A2 | 7/2008 |
| WO | 2008/095677 A1 | 8/2008 |
| WO | 2008/120203 A2 | 10/2008 |
| WO | 2008/138590 A1 | 11/2008 |
| WO | 2009/024445 A1 | 2/2009 |
| WO | 2009/037359 A1 | 3/2009 |
| WO | 2009/049138 A1 | 4/2009 |
| WO | 2009/114560 A2 | 9/2009 |
| WO | 2009/155535 A2 | 12/2009 |
| WO | 2010/007463 A1 | 1/2010 |
| WO | 2010/007533 A2 | 1/2010 |
| WO | 2010/014567 A2 | 2/2010 |
| WO | 2010/114106 A1 | 10/2010 |
| WO | 2010/125201 A1 | 11/2010 |
| WO | 2010/128338 A2 | 11/2010 |
| WO | 2010/148541 A1 | 12/2010 |
| WO | 2011/053798 A2 | 5/2011 |
| WO | 2011/076883 A1 | 6/2011 |
| WO | 2011/093858 A1 | 8/2011 |
| WO | 2011/119920 A2 | 9/2011 |
| WO | 2011/124371 A1 | 10/2011 |
| WO | 2011/143653 A2 | 11/2011 |
| WO | 2011/159938 A2 | 12/2011 |
| WO | 2012/034025 A2 | 3/2012 |
| WO | 2012/049317 A2 | 4/2012 |
| WO | 2012/051211 A2 | 4/2012 |
| WO | 2012/097105 A1 | 7/2012 |
| WO | 2012/106377 A2 | 8/2012 |
| WO | 2012/135177 A2 | 10/2012 |
| WO | 2012/141653 A1 | 10/2012 |
| WO | 2012/152644 A1 | 11/2012 |
| WO | 2012/170765 A2 | 12/2012 |
| WO | 2013/006838 A1 | 1/2013 |
| WO | 2013/006842 A2 | 1/2013 |
| WO | 2013/036465 A2 | 3/2013 |
| WO | 2013/054199 A2 | 4/2013 |
| WO | 2013/068847 A2 | 5/2013 |
| WO | 2013/144722 A2 | 10/2013 |
| WO | 2013/165982 A2 | 11/2013 |
| WO | 2014/005959 A1 | 1/2014 |
| WO | 2014/060594 A1 | 4/2014 |
| WO | 2014/068001 A1 | 5/2014 |
| WO | 2014/138086 A1 | 9/2014 |
| WO | 2014/138209 A1 | 9/2014 |
| WO | 2014/145932 A2 | 9/2014 |
| WO | 2014/200898 A2 | 12/2014 |
| WO | 2015/181142 A1 | 12/2015 |
| WO | 2016/092460 A2 | 6/2016 |
| WO | 2017/109629 A1 | 6/2017 |
| WO | 2019/169120 A1 | 9/2019 |
| WO | 2019/052975 A9 | 4/2020 |
| WO | WO-2021014385 A1 * | 1/2021 ............ A61K 39/12 |

OTHER PUBLICATIONS

Rieder, F. et al., "Cytomegalovirus vaccine: phase II clinical trial results", Clinical Microbiology and Infection 20 (Suppl. 5):95-102 (2014).

Rivailler, P. et al., "Genomic Sequence of Rhesus Cyomegalovirus 180.92: Insights into the Coding Potential of Rhesus Cytomegalovirus", Journal of Virology 80(8):4179-4182 (2006).

Roche et al., "Structure of the Prefusion Form of the Vesicular Stomatitis Virus Glycoprotein G", Science 315 (5813):843-848 (2007).

Roubalova, K. et al., "Genetic variability of cytomegalovirus glycoprotein O in hematopoietic stem cell transplant recipients", Transplant Infectious Disease 13(3):237-243 (2011).

Ryckman, B., et al. "Human Cytomegalovirus Entry into Epithelial and Endothelial Cells Depends on Genes UL128 to UL150 and Occurs by Endocytosis and Low-pH Fusion", Journal of Virology 80(2):710-722 (2006).

Ryckman, B. et al., "Characterization of the Human Cytomegalovirus gH/gL/UL128-131 Complex That Mediates Entry into Epithelial and Endothelial Cells", Journal of Virology 82(1):60-70 (2008).

Ryckman, B. et al., "HCMV gH/gL/UL128-131 interferes with virus entry into epithelial cells: Evidence for cell type-specific receptors", PNAS 105(37):14118-14123 (2008).

Saccoccio, F. et al., "Peptides from cytomegalovirus UL130 and UL131 proteins induce high titer antibodies that block viral entry into mucosal epithelial cells", Vaccine 29(15):2705-2711 (2011).

Sanchez, V. et al., "Accumulation of Virion Tegument and Envelope Proteins in a Stable Cytoplasmic Compartment During Human Cytomegalovirus Replication:Ccharacterization of a Potential Site of Virus Assembly", Journal of Virology, 74(2):975-986 (2000).

Sanchez, V. et al., "Viable Human Cytomegalovirus Recombinant Virus with an Internal Deletion of the IE2 86 Gene Affects Late Stages of Viral Replication", Journal of Virology 76(6):2973-2989 (2002).

Sandalova, E. et al., "Contribution of Herpesvirus Specific CD8 T Cells to Anti-Viral T Cell Response in Humans", PLoS Pathogens 6(8): e1001051 (2010).

Sanders, R.W et al., "A Next-Generation Cleaved, Soluble HIV-1 Env Trimer, BG505 SOSIP.664 gp140, Expresses Multiple Epitopes for Broadly Neutralizing but Not Non-Neutralizing Antibodies", Plos Pathogens 9(9):e1003618 (2013).

Satterwhite, T. et al., "Increased expression of cytotoxic effector molecules: Different interpretations for steroid-based and steroid-free immunosuppression", Pediatric Transplantation 7(1):53-58 (2003).

Scheres, "RELION: Implementation of a Bayesian approach to cryo-EM structure determination", Journal of Structural Biology 180:519-530 (2012).

Schleiss, M., "Cytomegalovirus Vaccine Development", Current Topics in Microbiology and Immunology 325:361-382 (2008).

Schleiss, M., "Cytomegalovirus vaccine strategies", Expert Opinion on Therapeutic Patents 18(4):375-385 (2008).

Schleiss, M. et al., "Cytomegalovirus vaccines and methods of production (WO20009049138): the emerging recognition of the importance of virus neutralization at the epithelial/endothelial interface", Expert Opinion on Therapeutic Patents 20(4):597-602 (2010).

Schleiss, M., "Cytomegalovirus vaccines under clinical development", Journal of Virus Eradication 2(4):198-207 (2016).

Schleiss, M., "Preventing Congenital Cytomegalovirus Infection: Protection to a 'T'", Trends in Microbiology 24(3):170-172 (2016).

Schmidt et al, "Peptide Inhibitors of Dengue-Virus Entry Target a Late-Stage Fusion Intermediate", PLoS Pathogens 6(4):e1000851 (2010).

Schuessler, A. et al., "Charge Cluster-to-Alanine Scanning of UL128 for Fine Tuning of the Endothelial Cell Tropism of Human Cytomegalovirus", Journal of Virology 82(22):11239-11246 (2008).

(56) References Cited

OTHER PUBLICATIONS

Schuessler, A. et al., "Mutational Mapping of pUL131A of Human Cytomegalovirus Emphasizes its Central Role for Endothelial Cell Tropism", Journal of Virology 86(1):504-512 (2012).
Schultz, E. et al., "Scanning Mutagenesis of Human Cytomegalovirus Glycoprotein gH/gL", Journal of Virology 90(5):2294-2305 (2015).
Scott & Smith, Searching for Peptide Ligands with an Epitope Library, Science 249(4967):386-390 (1990).
Scrivano, L. et al, "HCMV Spread and Cell Tropism are Determined by Distinct Virus Populations", PLoS Pathogen 7(1):e1001256 (2011).
Sebestyen et al, "Chemical Synthesis of Peptide Libraries", Bioorganic & Medicinal Chemistry Letters 3(3):413-418 (1993).
Seedah, E. et al., "Immunotherapeutic Approaches to Prevent Cytomegalovirus-Mediated Disease", Microbiology Spectrum 2(1):1-12 (2014).
Sharma, S. et al, "HCMV GB shares structural and functional properties with gB proteins from other herpesviruses", Virologyy 435(2):239-249 (2013).
Shi, X. et al., "Construction and characterization of new piggyBac vectors for constitutive or inducible expression of heterologous gene pairs and the identification of a previously unrecognized activator sequence in piggyBac" BMC Biotechnology 7:5 (2007).
Si et al, "Different functional states of fusion protein gB revealed on human cytomegalovirus by cryo electron tomography with Volta phase plate", PLoS Pathogens 14(12):e1007452 (2018).
Sindre, H. et al., "Human cytomegalovirus induced inhibition of hematopoietic cell line growth is initiated by events taking place before translation of viral gene products", Archives of Virology 145(1):99-111 (2000).
Sinzger, C. et al., "Cytomegalovirus Cell Tropism", Current Topics in Microbiology and Immunology 325:63-83 (2008).
Smith, G. et al, "Respiratory Syncytial Virus Fusion Glycoprotein Expressed in Insect Cells Form Protein Nanoparticles That Induce Protective Immunity in Cotton Rats", PLoS One:7(11):e50852 (2012).
Spear, P. et al., "Herpesvirus Entry: an Update", Journal of Virology 77(19):10179-10185 (2003).
Spindler, N. et al., "Structural Basis for the Recognition of Human Cytomegalovirus Glycoprotein B by a Neutralizing Human Antibody", PLoS Pathogens 10(10):e1004377 (2014).
Steininger, C. et al., "Frequency distribution and genetic distances of CMV strains found in different clinical specimens from immunocompetent and immunocompromised patients", Abstracts/Infection, Genetics and Evolution 5(3):305, Abstract 14 (2005).
Stewart-Jones, G.B.E. et al., "A Cysteine Zipper Stabilizes a Pre-Fusion F Glycoprotein Vaccine for Respiratory Syncytial Virus", PLos ONE 10(6):e0128779 (2015).
Stock, D. et al., "The evolution of the vertebrate D1x gene family", Proc. Natl. Acad. Sci. USA 93:10858-10863 (1996).
Straschewski, S., "The gene region UL128-UL131A of human cytomegalovirus (HCMV) is essential for monocyte nfection and block of migration:Characterisation of the infection of primary human monocytes", Dissertation presented to the Faculty of Medicine, University of Ulm (2010).
Straschewski, S., et al., "Protein pUL128 of Human Cytomegalovirus is Necessary for Monocyte Infection and Blocking of Migration", Journal of Virology, 85(10):5150-5158 (2011).
Sung, H. et al., "Update on the current status of cytomegalovirus vaccines", Expert Reviews, Vaccines 9(11):1303-1314 (2010).
Swanson, E. et al., "Comparison of monovalent glycoprotein B with bivalent GB/pp65 (GP83) vaccine for congenital cytomegalovirus infection in a guinea pig model: Inclusion of GP83 reduces gB antibody response but both vaccine approaches provide equivalent protection against pup mortality", Vaccine 33(32):4013-4018 (2015).
Tang, X-C. et al., "Baculovirus-Produced Influenza Virus-Like Particles in Mammalian Cells Protect Mice from Lethal nfluenza Challenge", Viral Immunology 24(4):311-319 (2011).
Terpe, K., "Overview of tag protein fusions: from molecular and biochemical fundamentals to commercial systems", Appl Microbiol Biotechnol 60(5):523-533 (2003).
Thompson and Ellman, "Synthesis and Applications of Small Molecule Libraries", Chemical Reviews 96:555-600 (1996).
Tischer, S. et al., "Heat shock protein 70/peptide complexes: potent mediators for the generation of antiviral T cells particularly with regard to low precursor frequencies", Journal of Translational Medicine 9(1):1-14 (2011).
Urnavicius et al, "The structure of the dynactin complex and its interaction with dynein", Science 347 (6229):1441-1446 (2015).
Vanarsdall, A. et al., "Human Cytomegalovirus Glycoproteins GB and gH/gL Mediate Epithelial Cell-Cell Fusion When Expressed Either in cis or in trans", Journal of Virology 82(23):11837-11850 (2008).
Vanarsdall, A. et al., "Human Cytomegalovirus Glycoprotein gO Complexes with gH/gL, Promoting Interference with Viral Entry into Human Fibroblasts but Not Entry into Epithelial Cells", Journal of Virology 85(22):11638-11645 (2011).
Vanarsdall, A. et al., "Human cytomegalovirus entry into cells", Current Opinion in Virology 2(1):37-42 (2012).
Gonczol, E. et al., "Development of a cytomegalovirus vaccine: lessons from recent clinical trials", Expert Opinion on Biological Therapy 1(3):401-412 (2001).
Goodford, "A Computational Procedure for Determining Energetically Favorable Binding Sites on Biologically Important Macromolecules", Journal of Medicinal Chemistry 28(7):849-857 (1985).
Gorzer, I. et al., "Virus Load Dynamics of Individual CMV-Genotypes in Lung Transplant Recipients with Mixed-Genotype Infections", Journal of Medical Virology 80(8):1405-1414 (2008).
Gorzer, I. et al., "Analysis of human cytomegalovirus strain populations in urine samples of newborns by ultra deep sequencing", Journal of Clinical Virology 73:101-104 (2015).
Gredmark, S. et al., "Human Cytomegalovirus Induces Inhibition of Macrophage Differentiation by Binding to Human Aminopeptidase N/CD13", Journal of Immunology 173(8):4897-4907 (2004).
Griesenbach, U. et al., "Gene therapy progress and prospects: cystic fibrosis". Gene Therapy 13(14):1061-1067 (2006).
Grosjean, J. et al., "Human cytomegalovirus quantification in toddlers saliva from day care centers and emergency unit: A feasibility study", Journal of Clinical Virology 61(3):371-377 (2014).
Habig et al, "Glutathione S-Transferases: The First Enzymatic Step in Mercapturic Acid Formation", The Journal of Biological Chemistry 249(22):7130-7139 (1974).
Hahn, G. et al., "Human Cytomegalovirus UL131-128 Genes are Indispensable for Virus Growth in Endothelial Cells and Virus Transfer to Leukocytes", Journal of Virology 78(18):10023-10033 (2004).
Halwachs-Baumann, G. et al., "Virus-host interaction for defence and transmission", BIOSIS Previews Congenital Cytomegalovirus Infection: Epidemiology, Diagnosis, Therapy 11-51 (2011).
Hansen, S. et al., "Cytomegalovirus Vectors Violate CD8+ T Cell Epitope Recognition Paradigms", Science 340:1237874-1-1237874-17 (2013).
Harrison, "Viral membrane fusion", Virology 479-480:498-507 (2015).
Hobom, U. et al., "Fast Screening Procedures for Random Transposon Libraries of Cloned Herpesvirus Genomes: Mutational Analysis of Human Cytomegalovirus Envelope Glycoprotein Genes", Journal of Virology 74(17):7720-7729 (2000).
Hofmann, I. et al., "Expression of the Human Cytomegalovirus Pentamer Complex for Vaccine Use in a CHO System", Biotechnology and Bioengineering 112(12):2505-2515 (2015).
Hui-Hui, G. et al., "Recombinant HCMV UL128 expression and functional identification of PBMC-attracting activity in vitro", Archives of Virology 158(1):173-177 (2013).
Ibig-Rehm, Y. et al., "High-content screening to distinguish between attachment and post-attachment steps of human cytomegalovirus entry into fibroblasts and epithelial cells", Antiviral Research 89(3):246-256 (2011).
Ikuta, K. et al., "Cytomegalovirus (CMV) glycoprotein H-based serological analysis in Japanese healthy pregnant women, and in

(56) References Cited

OTHER PUBLICATIONS neonates with congenital CMV infection and their mothers", Journal of Clinical Virology 58(2):474-478 (2013).
Ishibashi, K. et al., "Strain-specific seroepidemiology and reinfection of cytomegalovirus", Microbes and Infection 10(12-13):1363-1369 (2008).
Ishibashi, K. et al., "Lack of antibodies against the antigen domain 2 epitope of cytomegalovirus (CMV) glycoprotein B is associated with CMV disease after renal transplantation in recipients having the same glycoprotein H serotypes as their donors", Transplant Infectious Disease 13(3):318-323 (2011).
Jacob, C. et al., "Neutralizing antibodies are unable to inhibit direct viral cell-to-cell spread of human cytomegalovirus", Virology 444(1-2):140-147 (2013).
Jakes & Willett, "Pharmacophoric pattern matching in files of 3-D chemical structures: selection of interatomic distance screens", Journal of Molecular Graphics 4:12-20 (1986).
Jakes et al., "Pharmacophoric pattern matching in files of 3D chemical structures: evaluation of search performance", Journal of Molecular Graphics 5(1):41-48 (1987).
Jarvis, M. et al., "Human Cytomegalovirus Infection of Caco-2 Cells Occurs at the Basolateral Membrane and is Differentiation State Dependent", Journal of Virology 73(6):4552-4560 (1999).
Jaskula, E. et al., "Severe CMV load post HSCT is inversely correlated with a proportion of CD8high+ Pro5 pentamer HLA-A*0201/NLVPMVATV (CMV pp65)+ cells and associates with a risk of fatal complications", BIOSIS Previews Bone Marrow Transplantation 39(1):S163, Abstract P702 (2007).
Jiang, X. et al., "UL74 of human cytomegalovirus reduces the inhibitory effect of gH-specific and gB-specific antibodies", Archives of Virology 156(2):2145-2155 (2011).
Kabanova, A. et al., "Antibody-driven design of a human cytomegalovirus gHgLpUL128L subunit vaccine that selectively elicits potent neutralizing antibodies", PNAS 111(50):17965-17970 (2014).
Karlsson, H. et al., "Generation of Trispecific Cytotoxic T Cells Recognizing Cytomegalovirus, Adenovirus, and Epstein-Barr Virus: An Approach for Adoptive Immunotherapy of Multiple Pathogens", Journal of Immunotherapy 30(5):544-556 (2007).
Kinzler, E. et al., "Characterization of Human Cytomegalovirus Glycoprotein-Induced Cell-Cell Fusion", Journal of Virology 79(12):7827-7837 (2005).
Klein, M. et al., "Strain-Specific Neutralization of Human Cytomegalovirus Isolates by Human Sera", Journal of Virology 73(2):878-886 (1999).
Klinger, M. et al., "Combining Next-Generation Sequencing and Immune Assays: A Novel Method for Identification of Antigen-Specific T Cells", PLoS ONE, 8(9):e74231 (2013).
Klupp, B. et al., "Pseudorabies Virus Glycoprotein M Inhibits Membrane Fusion", Journal of Virology 74(15):6760-6768 (2000).
Kropff, B. et al., "Glycoprotein N of Human Cytomegalovirus Protects the Virus from Neutralizing Antibodies", PLoS Pathogens 8(10):e1002999 (2012).
Kuntz et al, "A geometric approach to macromolecule-ligand interactions", Journal of Molecular Biology 161(2):269-288 (1982).
Kuntz, M. et al., "Analysis of bulk and virus-specific CD8+ T cells reveals advanced differentiation of CD8+ T cells in patients with common variable immunodeficiency", Clinical Immunology 141(2):177-186 (2011).
Lam et al, "Rational Design of Potent, Bioavailable, Nonpeptide Cyclic Ureas as HIV Protease Inhibitors", Science 263(5145):380-384 (1994).
Landais, I. et al., "Human Cytomegalovirus miR-UL112-3p Targets TLR2 and Modulates the TLR2/IRAK1/NFkappaB Signaling Pathway", PLoS Pathogens 11(5):e1004881 (2015).
Lauron, E. et al., "Human Cytomegalovirus Infection of Langerhans-Type Dendritic Cells Does Not Require the Presence of the gH/gL/UL128-131A Complex and is Blocked after Nuclear Deposition of Viral Genomes in Immature Cells", Journal of Virology 88(1):403-416 (2014).
Lawrence & Davis, "CLIX: A Search Algorithm for Finding Novel Ligands Capable of Binding Proteins of Known Three-Dimensional Structure", Proteins: Structure, Function and Bioinformatics 12(1):31-41 (1992).
Lee, J.K. et al., "Reversible Inhibition of the Fusion Activity of Measles Virus F Protein by an Engineered Intersubunit Disulfide Bridge", Journal of Virology 81(16):8821-8826 (2007).
Lee, S. et al., "Monitoring of Cytomegalovirus-Specific CD8+ T-Cell Response With Major Histocompatibility Complex Pentamers in Kidney Transplant Recipients", Transplantation Proceedings 43(7):2636-2640 (2011).
Lee, P.S. et al., "Design and Structure of an Engineered Disulfide-Stabilized Influenza Virus Hemagglutinin Trimer", Journal of Virology 89(14):7417-7420 (2015).
Li, L. et al., "Glycoprotein H-Related Complexes of Human Cytomegalovirus: Identification of a Third Protein in the gCIII Complex", Journal of Virology 71(4):3090-3097 (1997).
Li, G. et al., "A viral regulator of glycoprotein complexes contributes to human cytomegalovirus cell tropism", PNAS 112(14):4471-4476 (2015).
Li, Q. et al., "THY-1 Cell Surface Antigen (CD90) Has an Important Role in the Initial Stage of Human Cytomegalovirus Infection", PLoS Pathogens 11(7):E1004999 (2015).
Lilja, A. et al., "Efficient replication of rhesus cytomegalovirus variants in multiple rhesus and human cell types", PNAS 105(50):19950-19955 (2008).
Lilleri, D. et al., "Antibodies Against Neutralization Epitopes of Human Cytomegalovirus gH/gL/pUL128-130-131 Complex and Virus Spreading May Correlate with Virus Control In Vivo", Journal of Clinical Immunology 32(6):1324-1331 (2012).
Lilleri, D. et al., "Fetal Human Cytomegalovirus Transmission Correlates with Delayed Maternal Antibodies to gH/gL/pUL128-130-131 Complex during Primary Infection", PLoS ONE 8(3):e59863 (2013).
Li Pira, G. et al., "A sealed and unbreached system for purification, stimulation, and expansion of cytomegalovirus-specific human CD4 and CD8 T lymphocytes", Transfusion 46(12):2053-2062 (2006).
Liu, A. et al., "Evaluation of human cytomegalovirus-specific CD8+ T-cells in allogeneic haematopoietic stem cell transplant recipients using pentamer and interferon-gamma-enzyme-linked immunospot assays", Journal of Clinical Virology 58(2):427-431 (2013).
Liu, A. et al., "Preliminary exploration of HLA-A 1101-restricted human cytomegalovirus glycoprotein B-specific CD8+ T cells in allogeneic stem-cell transplant recipients", Virus Research 188:38-44 (2014).
Liu, G. et al., "Protective MCMV immunity by vaccination of the salivary gland via Wharton's duct: replication-deficient recombinant adenovirus expressing individual MCMV genes elicits protection similar to that of MCMV", The FASEB Journal 28(4):1698-1710 (2014).
Liu et al, "Prefusion structure of human cytomegalovirus glycoprotein B and structural basis for membrane fusion", Science Advances 7(10):eabf3178 (2021).
Loomis, R. et al., "Vectored co-delivery of human cytomegalovirus gH and gL proteins elicits potent complement-independent neutralizing antibodies", Vaccine 31(6):919-926 (2013).
Lopper, M. et al., "Coiled-Coil Domains in Glycoproteins B and H are Involved in Human Cytomegalovirus Membrane Fusion", Journal of Virology 78(15):8333-8341 (2004).
Loughney, J. et al., "Soluble Human Cytomegalovirus gH/gL/pUL128-131 Pentameric Complex, but Not gH/gL, Inhibits Viral Entry to Epithelial Cells and Presents Dominant Native Neutralizing Epitopes", The Journal of Biological Chemistry 290(26):15985-15995 (2015).
Ludtke et al, "EMAN: Semiautomated Software for High-Resolution Single-Particle Recontructions", Journal of Structural Biology 128(1):82-97 (1999).
Ma, Y. et al., "Novel transcripts of human cytomegalovirus clinical strain found by cDNA library screening", Genetics and Molecular Research 10(2):566-575 (2011).
Macagno, A. et al., "Isolation of Human Monoclonal Antibodies That Potently Neutralize Human Cytomegalovirus Infection by

(56) References Cited

OTHER PUBLICATIONS

Targeting Different Epitopes on the gH/gL/UL128-131A Complex", Journal of Virology 84(2):1005-1013 (2010).
Madi, N. et al., "Cytomegalovirus Genotypes gB1 and gH1 are the Most Predominant Genotypes among Renal Transplant Recipients in Kuwait", Transplantation Proceedings, 43(5):1634-1637 (2011).
Maidji et al., "Impaired Surfactant Production by Alveolar Epithelial Cells in a SCID-hu Lung Mouse Model of Congenital Human Cytomegalovirus Infection", Journal of Virology 86(23):12795-12805 (2012).
"Manley, K et al., ""Human Cytomegalovirus Escapes a Naturally Occurring NeutralizingAntibody by Incorporating it into Assembling Virions"", Cell Host & Microbe 10(3):197-209 (2011)".
Mattick, C. et al., "Linkage of human cytomegalovirus glycoprotein gO variant groups identified from worldwide clinical isolates with gN genotypes, implications for disease associations and evidence for N-terminal sites of positive selection", Virology 318(2):582-597 (2004).
McCormick, L. et al., "The immunological underpinnings of vaccinations to prevent cytomegalovirus disease", Cellular & Molecular Immunology 12(2):170-179 (2015).
McLellan, J.S. et al., "Structure-Based Design of a Fusion Glycoprotein Vaccine for Respiratory Syncytial Virus", Science 342(6158):592-598 (2013).
McSharry, B. et al., "Human Cytomegalovirus Encoded Homologs of Cytokines, Chemokines and their Receptors: Roles in Immunomodulation", Viruses 4(11):2448-2470 (2012).
McVoy, M. et al., "Cytomegalovirus Vaccines", Clinical Infectious Diseases, 57(4):S196-S199 (2013).
McVoy, M. et al., "A cytomegalovirus DNA vaccine induces antibodies that block viral entry into fibroblasts and epithelial cells", Vaccine 33(51):7328-7336 (2015).
Meyer, H. et al., "Glycoprotein gp116 of human cytomegalovirus contains epitopes for strain-common and strain-specific antibodies", Journal of General Virology 73:2375-2383 (1992).
Mochizuki, T. et al., "Cucumber mosaic virus: viral genes as virulence determinants", Molecular Plant Pathology 13(3):217-225 (2012).
Müller, T. et al., "Pattern and persistence of the epitope-specific IgM response against human cytomegalovirus in renal transplant patients", Journal of Clinical Virology 24(1-2):45-56 (2002).
Murhammer, D., Editor "Baculovirus and Insect Cell Expression Protocols" 2nd Ed. Methods in Molecular Biology 388 (2007).
Murrell, I. et al., "Impact of Sequence Variation in the UL128 Locus on Production of Human Cytomegalovirus in Fibroblast and Epithelial Cells", Journal of Virology 87(19):10489-10500 (2013).
NCBI Accession P13201 (2021).
Nejatollahi, F. et al., "Neutralising human recombinant antibodies to human cytomegalovirus glycoproteins gB and gH", FEMS Immunology and Medical Microbiology 34(3):237:244 (2002).
Mellore A. et al., "The cyclin dependent kinase inhibitor (R)-roscovitine mediates selective suppression of alloreactive human T cells but preserves pathogen-specific and leukemia-specific effectors", Clinical Immunology 152(1-2):48-57 (2014).
Nie, Y. et al., "Multiprotein Complex Production in Insect Cells by Using Polyproteins", Methods in Molecular Biology 1091:131-141 (2014).
Nogalski, M. et al., "The Human Cytomegalovirus Virion Possesses an Activated Casein Kinase II That Allows for the Rapid Phosphorylation of the Inhibitor of NF-kappaB, IkappaBalpha", Journal of Virology 81(10):5305-5314 (2007).
Nogalski, M. et al., "The HCMV gH/gL/UL128-131 Complex Triggers the Specific Cellular Activation Required for Efficient Viral Internalization into Target Monocytes", PLoS Pathogens 9(7):e1003463 (2013).
Ohlin, M. et al., "Human antibody technology and the development of antibodies against cytomegalovirus", Molecular Immunology 67:153-170 (2015).

"Okada, T. et al. ""N-Glycosylation engineering of lepidopteraninsect cells by the introduction of the beta1,4-N-acetylglucosaminyltransferase III gene""", Glycobiology 20(9):1147-1159 (2010)".
Omoto, S. et al., "Transcription of True Late (gamma2) Cytomegalovirus Genes Requires UL92 Function That is Conserved among Beta- and Gammaherpesviruses", Journal of Virology 88(1):120-130 (2014).
O'Reilly DR, et al., "Gene Organization, Regulation, and Function", Baculovirus Expression Vectors: A Laboratory Manual, Oxford University Press, Chapter 2, pp. 12-23 (1994).
Pachnio, A. et al., "The Cellular Localization of Human Cytomegalovirus Glycoprotein Expression Greatly Influences the Frequency and Functional Phenotype of Specific CD4+ T Cell Responses", The Journal of Immunology 195(8):3803-3815 (2015).
Pass, R.F. et al., "A Subunit Cyomegalovirus Vaccine Based on Recombinant Envelope Glycoprotein B and a New Adjuvant", The Journal of Infectious Diseases 180:970-975 (1999).
Pati, S. et al., "Strain-Specific Neutralizing Antibody Responses against Human Cytomegalovirus Envelope Glycoprotein N", Clinical and Vaccine Immunology 19(6):909-913 (2012).
Pati, S. et al., "Genotypic Diversity and Mixed Infection in Newborn Disease and Hearing Loss in Congenital Cytomegalovirus Infection", The Pediatric Infectious Disease Journal, 32(10):1050-1054 (2013).
Patrone, M. et al., "Cytomegalovirus UL131-128 Products Promote gB Conformational Transition and gB-gH Interaction during Entry into Endothelial Cells", Journal of Virology 81(20):11479-11488 (2007).
Patrone, M., et al., "Palmitoylation Strengthens Cholesterol-Dependent Multimerization and Fusion Activity of Human Cytomegalovirus Glycoprotein B (gB)", Journal of Bilogical Chemistry, 291(9):4711-4722 (2016).
PCT International Search Report for International Application No. PCT/IB2021/055396 dated Oct. 5, 2021.
Peppenelli, M. et al., "Human Cytomegalovirus Stimulates the Synthesis of Select Akt-Dependent Antiapoptotic Proteins during Viral Entry to Promote Survival of Infected Monocytes", Journal of Virology 90(6):3138-3147 (2016).
Pepperl S. et al., "Dense Bodies of Human Cytomegalovirus Induce both Humoral and Cellular Immune Responses in the Absence of Viral Gene Expression", Journal of Virology 74(13):6132-6146 (2000).
Plotkin, S., "Vaccination against cytomegalovirus, the changeling demon", The Pediatric Infectious Disease Journal, 18(4):313-326 (1999).
Plotkin, S., "The history of vaccination against cytomegalovirus", Medical Microbiology & Immunology 204(3):247-254 (2015).
Pötzsch et al., "B Cell Repertoire Analysis Identifies New Antigenic Domains on Glycoprotein B of Human Cytomegalovirus which are Target of Neutralizing Antibodies", PLoS Pathogens 7(8):e1002172 (2011).
Ramirez, N. et al., "Viral-specific adoptive immunotherapy after allo-SCT: the role of multimer-based selection strategies", Bone Marrow Transplantation, 48(10):1265-1270 (2013).
Rasmussen, L. et al., "Cytomegalovirus gB Genotype Distribution Differs in Human Immunodeficiency Virus-Infected Patients and Immunocompromised Allograft Recipients", The Journal of Infectious Diseases 175(1):179-184 (1997).
Rasmussen, L et al., "Inter- and Intragenic Variations Complicate the Molecular Epidemiology of Human Cytomegalovirus", The Journal of Infectious Diseases 187(5):809-819 (2003).
Rautenberg, P. et al., "Evaluation of the AmpliSensor PCR and the SHARP signal detection system for the early prediction of symptomatic CMV infection in solid transplant recipients", Journal of Clinical Virology 13(1-2):81-94 (1999).
Reschke, M. et al., "Constitutive Expression of Human Cytomegalovirus (HCMV) Glycoprotein gpUL75 (gH) in Astrocytoma Cells: A Study of the Specific Humoral Immune Response", Viral Immunology 12(3):249-262 (1999).
Revello, M. et al., "Human cytomegalovirus tropism for endothelial/epithelial cells: scientific background and clinical implications", Reviews in Medical Virology 20(3):136-155 (2010).

(56) References Cited

OTHER PUBLICATIONS

Vanarsdall, A. et al., "PDGF Receptor-Alpha Does Not Promote HCMV Entry into Epithelial and Endothelial Cells but Increased Quantities Stimulate Entry by an Abnormal Pathway", PLoS Pathogens 8(9):e1002905 (2012).
Van Zanten, J. et al., "Humoral Immune Response against Human Cytomegalovirus (HCMV)-Specific Proteins after HCMV Infection in Lung Transplantation as Detected with Recombinant and Naturally Occurring Proteins", Clinical and Diagnostic Laboratory Immunology 2(2):214-218 (1995).
Vijayachandran, L. et al., "Gene gymnastics: Synthetic biology for baculovirus expression vector system engineering", Bioengineered 4:(5):279-287 (2013).
Vogel, J. et al., "Model for the Evaluation of Novel Antivirals to Prevent HCMV Dissemination", Antiviral Research 50(1):A66, Abstract 95 (2001).
Vogel, J. et al., "Role of human cytomegalovirus genotype polymorphisms in AIDS patients with cytomegalovirus retinitis", Medical Microbiology & Immunology 202(1):37-47 (2013).
Vomaske, J. et al., "Cytomegalovirus CC Chemokine Promotes Immune Cell Migration", Journal of Virology 86(21):11833-11844 (2012).
Wallace, D. et al., "Human cytomegalovirus-specific CD8+ T-cell expansions contain long-lived cells that retain functional capacity in both young and elderly subjects", Immunology 132(1):27-38 (2011).
Wang, D. et al., "Human cytomegalovirus virion protein complex required for epithelial and endothelial cell tropism", PNAS 102(50):18153-18158 (2005).
Wang. X., et al., "Integrin αvβ3 is a Coreceptor for Human Cytomegalovirus", Nature Medicine, 11(5):515-521 (2005).
Wang, D. et al., "Progress on human cytomegalovirus vaccines for prevention of congenital infection and disease", Current Opinion in Virology 6(1):13-23 (2014).
Wen, Y. et al., "Human cytomegalovirus gH/ gL/UL128/UL130/UL131A complex elicits potently neutralizing antibodies in mice", Vaccine 32(30):3796-37804 (2014).
West & Fairlie, "Targeting HIV-1 protease: a test of drug-design methodologies", Trends in Pharmacological Sciences 16(2):67-75 (1995).
White, E. et al., "The Incredible Stability of Postfusion HCMV Glycoprotein B", Award Winners and Abstracts of the 31st Annual Symposium of the Protein Society, Abstract # POS416. Montreal, Canada Jul. 24-27, 2017.
Wilkinson, G. et al., "Human cytomegalovirus: taking the strain", Medical Microbiology and Immunology 204(3):273-284 (2015).
Wille, P. et al., "A Human Cytomegalovirus gO-Null Mutant Fails to Incorporate gH/gL into the Virion Envelope and is Unable to Enter Fibroblasts and Epithelial and Endothelial Cells", Journal of Virology 84(5):2585-2596 (2010).
Wille, P. et al., "Human Cytomegalovirus (HCMV) Glycoprotein gB Promotes Virus Entry in Trans Acting as the Viral Fusion Protein Rather than as a Receptor-Binding Protein", mBio 4(3):e00332-13 (2013).
Wlodawer & Erickson, "Structure-Based Inhibitors of HIV-1 Protease", Annu. Rev. Biochem. 62:543-585 (1993).
Woo, P. et al., "Distinct Genotypic Distributions of Cytomegalovirus (CMV) Envelope Glycoprotein in Bone Marrow and Renal Transplant Recipients with CMV Disease", Clinical and Diagnostic Laboratory Immunology 4(5):515-518 (1997).
Wreghitt, T. et al., "Differentiation of Human Cytomegalovirus (CMV) Glycoprotein B and Glycoprotein H Types by Restriction Fragment Length Polymorphism: Association of Glycoprotein Types with CMV Disease in Heart, Heart-Lung and Lung Transplant Recipients", The Journal of Heart and Lung Transplantation, 18(1):82, Abstract 198 (1999).
Wu, S. et al., "Synthetic DNA Approach to Cytomegalovirus Vaccine/Immune Therapy", Advances in Experimental Medicine and Biology 848:131-148 (2015).
Wussow, F. et al., "A Vaccine Based on the Rhesus Cytomegalovirus UL128 Complex Induces Broadly Neutralizing Antibodies in Rhesus Macaques", Journal of Virology 87(3):1322-1332 (2013).
Wussow, F. et al., "Human Cytomegalovirus Vaccine Based on the Envelope gH/gL Pentamer Complex", PLoS Pathogens 10(11):e1004524 (2014).
Yamada, S et al., "Characterization of the guinea pig cytomegalovirus genome locus that encodes homologs of human cytomegalovirus major immediate-early genes, UL128, and UL130", Virology 391(1):99-106 (2009).
Yamada, S. et al., "Guinea pig cytomegalovirus GP129/131/133, homologues of human cytomegalovirus UL128/130/131A, are necessary for infection of monocytes and macrophages", Journal of General Virology 95(Pt6):1376-1382 (2014).
Yamada, S. et al., "An Ex vivo culture model for placental cytomegalovirus infection using slices of Guinea pig Placental tissue", Placenta 37:85-88 (2016).
Yamamoto, A. et al., "Diagnosis of congenital and perinatal infection by cytomegalovirus using polymerase chain reaction" [Portuguese] "Diagnóstico de infecção congênita e perinatal por citomegalovirus utilizando a Reação em cadeia da polimerase", Revista Da Sociedade Brasileira de Medicina Tropical 31(1):19-26 (1998) (English title & abstract only).
Yao, J. et al., "Multimer Staining of Cytomegalovirus Phosphoprotein 65-Specific T Cells for Diagnosis and Therapeutic Purposes: A Comparative Study", Clinical Infectious Diseases 46(10):E96-E105 (2008).
Yurochko, A. et al., "The Human Cytomegalovirus UL55 (gB) and UL75 (gH) Glycoprotein Ligands Initiate the Rapid Activation of Sp1 and NF-kappaB during Infection", Journal of Virology 719(7):5051-5059 (1997).
Yurochko, A. et al., "Human Cytomegalovirus Binding to Human Monocytes Induces Immunoregulatory Gene Expression", Journal of Immunology 162(8):4806-4816 (1999).
Zhang, "Gctf: Real-time CTF determination and correction", Journal of Structural Biology, 193:1-12 (2016).
Zheng, Q. et al., "HCMV-Encoded UL128 Enhances TNF-alpha and IL-6 Expression and Promotes PBMC Proliferation Through the MAPK/ERK Pathway In Vitro", Viral Immunology 25(2):98-105 (2012).
Zheng et al., "MotionCor2: anisotropic correction of beam-induced motion for improved cryo-electron microscopy", Nature Methods 14(4):331-332 (2017).
Zhou, L. et al., "Genetic variation within the glycoprotein B and H genes of human cytomegalovirus in solid organ transplant recipients", Transplant Infectious Disease 9(1):73-77 (2007).
Zhou, M. et al., "Comparative Analysis of gO Isoforms Reveals that Strains of Human Cytomegalovirus Differ in the Ratio of gH/gL/gO and gH/gL/UL128-131 in the Virion Envelope", Journal of Virology 87(17):9680-9690 (2013).
Zhou, M. et al., "Human Cytomegalovirus gH/gL/gO Promotes the Fusion Step of Entry into All Cell Types, whereas gH/gL/UL128-131 Broadens Virus Tropism through a Distinct Mechanism", Journal of Virology 89(17):8999-9009 (2015).
Zipeto, D. et al., "Human Cytomegalovirus (CMV) DNA in Plasma Reflects Quantity of CMV DNA Present in Leukocytes", Journal of Clinical Microbiology 33(10):2607-2611 (1995).
Zydek, M. et al., "HCMV Infection of Human Trophoblast Progenitor Cells of the Placenta is Neutralized by a Human Monoclonal Antibody to Glycoprotein B and Not by Antibodies to the Pentamer Complex", Viruses 6(3):1346-1364 (2014).
SEQ ID #46 comparison (Year: 2022) cited by the USPTO in Mar. 24, 2022 Final Office Action issued in connection with U.S. Appl. No. 16/721,229.
Chou, S., "Molecular Epidemiology of Envelope Glycoprotein H of Human Cytomegalovirus", The Journal of Infectious Diseases 166(3):604-607 (1992).
Ciferri, C., et al., "Antigenic Characterization of the HCMV gH/gL/gO and Pentamer Cell Entry Complexes Reveals Binding Sites for Potently Neutralizing Human Antibodies", PLoS Pathogens 11(10):e1005230 (2015).

(56) References Cited

OTHER PUBLICATIONS

Ciferri, C., et al.,"Structural and biochemical studies of HCMV gH/gL/gO and Pentamer reveal mutually exclusive cell entry complexes", PNAS 112(6):1767-1772 (2015).
Cohen et al., "Molecular Modeling Software and Methods for Medicinal Chemistry", Journal of Medicinal Chemistry 33(3):883-894 (1990).
Coleman, S., et al., "Viral Glycoprotein Complex Formation, Essential Function and Immunogenicity in the Guinea Pig Model for Cytomegalovirus", PLoS ONE, 10(8):e0135567 (2005).
Compton, T., "An Immortalized Human Fibroblast Cell Line is Permissive for Human Cytomegalovirus Infection", Journal of Virology 67(6):3644-3648 (1993).
Corti, D., et al., "Efficient Methods to Isolate Human Monoclonal Antibodies from Memory B Cells and Plasma Cells", Microbiology Spectrum 2(5):AID-0018-2014.
Cox, M. et al, "A fast track influenza virus vaccine produced in insect cells", Journal of Invertebrate Pathology 107:S31-S41 (2011).
Crawford et al, "Humanized mouse models of human cytomegalovirus infection", Current Opinion in Virology 13:86-92 (2015).
Cruz Cosme, R. et al., "Functional Interaction of Nuclear Domain 10 and its Components with Cytomegalovirus after Infections: Cross-Species Host Cells versus Native Cells", PLoS ONE, 6(4):e19187 (2011).
Cwirla et al, "Peptides on phage: A vast library of peptides for identifying ligands", Proc. Natl. Acad. Sci. 87:6378-6382 (1990).
Czarnik, "Encoding methods for combinatorial chemistry", Current Opinion in Chemical Biology 1(1):60-66 (1997).
Daniel, V. et al., "HIV-Specific CD8+ T Lymphocytes in Blood of Long-Term HIV-Infected Hemophilia Patients", BioResearch Open Access 2(6):399-411 (2013).
Database Geneseq [Online] Jun. 7, 2012, "Cytomegalovirus glycoprotein B (gB)-SLP12-Delta725 Polypeptiede SEQ 10", database accession No. GSP:AZV29616; XP002769687.
Database Uniprot [Online] Jun. 15, 2010, "Envelope glycoprotein B, Macanine betaherpesvirus 3, Rhesus cytomegalovirus", database accession No. D5KB35; XP002769689.
Database Uniprot [Online] Mar. 19, 2014, "Envelope Glycoprotein B, Human Cytomegalovirus", database accession No. V9LN55; XP002769688.
Decrion, A-Z. et al., "A subset of functional effector-memory CD8+ T lymphocytes in human immunodeficiency virus-infected patients". Immunology 121(3)405-415 (2007).
Desjarlais et al., "Docking Flexible Ligands to Macromolecular Receptors by Molecular Shape", Journal of Medicina Chemistry 29(11):2149-2153 (1986).
Desjarlais et al., "Using Shape Complementarity as an Initial Screen in Designing Ligands for a Receptor Binding Site of Known Three-Dimensional Structure", Journal of Medicinal Chemistry 31(4):722-729 (1988).
Devlin et al., "Random Peptide Libraries: A Source of Specific Protein Binding Molecules", Science 249(4967):404-406 (1990).
DeVries, et al., "Rapid Genotyping of Cytomegalovirus in Dried Blood Spots by Multiplex Real-Time PCR Assays Targeting the Envelope Glycoprotein gB and gH Genes, Journal of Clinical Microbiology, 50(2)232-237 (2012).
DeVries, J. et al., "Cytomegalovirus DNA detection in dried blood spots and perilymphatic fluids from pediatric and adult cochlear implant recipients with prelingual deafness", Journal of Clinical Virology 56(2):113-117 (2013).
Digel, M. et al., "Determinants of Endothelial Cell Tropism of Human Cytomegalovirus", Molecular Biology and Immunology 445-464 (2006).
Dolan, A. et al., "Genetic content of wild-type human cytomegalovirus", Journal of General Virology, 85:1301-1312 (2004).
Douvas, A. et al., "Multiple overlapping homologies between two rheumatoid antigens and immunosuppressive viruses". Proc. Natl. Acad Sci. USA 88(14):6328-6332 (1991).

Dunbrack et al., "Meeting review: the Second Meeting on the Critical Assessment of Techniques for Protein Structure Prediction (CASP2), Asilomar, California, Dec. 13-16, 1996", Folding & Design 2:27-42 (1997).
Eggers, M. et al., "Use of Recombinant Glycoprotein Antigens gB and gH for Diagnosis of Primary Human Cytomegalovirus Infection During Pregnancy", Journal of Medical Virology 63(2):135-142 (2001).
Eisenberg, R. et al., "Herpes Virus Fusion and Entry: A Story with Many Characters", Viruses 4(5):800-832 (2012).
Elkington, R. et al., "Cross-reactive recognition of human and primate cytomegalovirus sequences by human CD4 cytotoxic T lymphocytes specific for glycoprotein B and H", Eur. J. Immunol. 34(11):3216-3226 (2004).
Ellison and Hochstrasser, "Epitope-tagged Ubiquitin: A New Probe for Analyzing Ubiquitin Function", The Journal of Biological Chemistry 266(31):21150-21157 (1991).
Emsley et al., "Features and development of Coot", Acta Crystallographica Section D—Biological Crystallography D66:486-501 (2010).
Engel, P. et al., "Viral Immunomodulatory Proteins: Usurping Host Genes as a Survival Strategy", Self and Nonself Advances in Experimental Medicine and Biology 738:256-276 (2012).
English, E. et al., "Foldamer-Based Inhibitors of Cytomegalovirus Entry", Antiviral Research 70(1):A32, Abstract 17 (2006).
English, E. et al., "Rational Development of Beta-Peptide Inhibitors of Human Cytomegalovirus Entry", The Journal of Biological Chemistry 281(5):2661-2667 (2006).
Erickson, "Design and structure of symmetry-based inhibitors of HIV-1 protease", Perspectives in Drug Discovery and Design 1:109-128 (1993).
Fornara, O. et al., "Human cytomegalovirus particles directly suppress CD4 T-lymphocyte activation and proliferation", Immunobiology 218(8):1034-1040 (2013).
Fouts, A. et al., "Antibodies against the gH/ gL/UL128/UL130/UL131 Complex Comprise the Majority of the Anti-Cytomegalovirus (Anti-CMV) Neutralizing Antibody Response in CMV Hyperimmune Globulin", Journal of Virology 86(13):7444-7447 (2012).
Fouts, A. et al., "Mechanism for neutralizing activity by the anti-CMV gH/gL monoclonal antibody MSL-109", PNAS, 111(22):8209-8214 (2014).
Freed, D.C. et al., "Pentameric complex of viral glycoprotein H is the primary target for potent neutralization by a human cytomegalovirus vaccine", Proceedings of the National Academy of Sciences, 110(51):E4997-E5005 (2013).
Fu, T-M. et al., "Restoration of viral epithelial tropism improves immunogenicity in rabbits and rhesus macaques for a whole virion vaccine of human cytomegalovirus", Vaccine 30(52):7469-7474 (2012).
Fu, T-M. et al., "Progress on pursuit of human cytomegalovirus vaccines for prevention of congenital infection and disease", Vaccine 32(22):2525-2533 (2014).
Fukushima, E. et al., "Identification of a highly conserved region in the human cytomegalovirus glycoprotein H gene and design of molecular diagnostic methods targeting the region", Journal of Virological Methods 151(1):55-60 (2008).
Furka et al, "General method for rapid synthesis of multicomponent peptide mixtures", International Journal of Peptide and Protein Research 37:487-493 (1991).
Ge, X. et al., "CD134-Allodepletion Allows Selective Elimination of Alloreactive Human T Cells Without Loss of Virus-Specific and Leukemia-Specific Effectors", Biology of Blood and Marrow Transplatation 14(5):518-530 (2008).
Genini, E. et al., "Serum antibody response to the gH/gL/pUL128-131 five-protein complex of human cytomegalovirus (HCMV) in primary and reactivated HCMV infections", Journal of Clinical Virology 52(2):113-118 (2011).
Gerna, G. et al., "Dendritic-cell infection by human cytomegalovirus is restricted to strains carrying functional UL131-128 genes and mediates efficient viral antigen presentation to CD8+ T cells", Journal of General Virology 36:275-284 (2005).

(56) References Cited

OTHER PUBLICATIONS

Gerna, G. et al., "Human cytomegalovirus serum neutralizing antibodies block virus infection of endothelial/epithelial cells, but not fibroblasts, early during primary infection", Journal of General Virology 89:853-865 (2008).
Gerna, G. et al., "Differential kinetics of human cytomegalovirus load and antibody responses in primary infection of the immunocompetent and immunocompromised host", Journal of General Virology, 96:360-369 (2015).
Gill, T. et al.,"Replication-defective Mutants of Mouse Cytomegalovirus Protect Against Wild-Type Virus Challenge", Journal of Medical Virology 62(2):127-139 (2000).
Gnanandarajah, J et al., "Identification by Mass Spectrometry and Immune Response Analysis of Guinea Pig Cytomegalovirus (GPCMV) Pentameric Complex Proteins GP129, 131 and 133", Viruses 6(2):727-751 (2014).
Achour, A., et al., "Variability of gB and gH Genes of Human Herpesvirus-6 Among Clinical Specimens", Journal of Medical Virology 80:1211-1221 (2008).
Adler, B., et al., "Role of human cytomegalovirus UL131A in cell type-specific virus entry and release", Journal of General Virology 87:2451-2460 (2006).
Adler, B., et al., "Endothelial cells in human cytomegalovirus infection: One host cell out of many or a crucial target for virus spread?", Thrombosis & Haemostasis 102(6): 1057-1063 (2009).
Adler, S., "Immunization to prevent congenital cytomegalovirus infection", British Medical Bulletin 107:57-68 (2013).
Afonine et al., "Real-space refinement in PHENIX for cryo-EM and crystallography", Acta Crystallography D-Structural Biology D74:531-544 (2018).
Akter, et al., "Two novel spliced genes in human cytomegalovirus", Journal of General Virology 84: 1117-1122 (2003).
Al-Ahdal, et al., "Typing of Human Cytomegalovirus Clinical Isolates from Saudi Patients by PCR-RFLP", Infection 33(2):73-76 (2005).
Albon, et al., "Optimization of methodology for production of CD25/CD71 allodepleted donor T cells for clinical use", Cytotherapy 15:109-121 (2013).
Allen et al., "Cambridge Crystallographic Data Centre. II. Structural Data File", Journal of Chemical Documentation 13(3):119-123 (1973).
Almehmadi, M., et al., "Increased numbers and functional activity of CD56+ T cells in healthy cytomegalovirus positive subjects", Immunology 142(2):258-268 (2014).
Angelini, D., et al., "Increased CD8+ T Cell Response to Epstein-Barr Virus Lytic Antigens in the Active Phase of Multiple Sclerosis", PLoS Pathogens 9(4):e1003220 (2013).
Appelt, "Crystal structures of HIV-1 protease-inhibitor complexes", Perspectives in Drug Discovery and Design 1:23-48 (1993).
Aquino, V., et al., "Cytomegalovirus infection in renal transplant recipients diagnosed by nested-PCR", Brazilian Journal of Medical and Biological Research 34(1):93-101 (2001).
Arav-Boger, "Strain Variation and Disease Severity in Congenital Cytomegalovirus Infection: In Search of a Viral Marker", Infectious Disease Clinics of North America 29(3):401-414 (2015).
Assaf, B., et al., "Limited Dissemination and Shedding of the UL128 Complex-Intact, UL/b'-Defective Rhesus Cytomegalovirus Strain 180.92", Journal of Virology 88(16):9310-9320 (2014).
Auerbach, et al., "Characterization of the guinea pig CMV gH/gL/GP129/GP131/GP133 complex in infection and spread", Virology 441 (1):75-84 (2013).
Baldanti, S., et al., "Human cytomegalovirus UL131A, UL130 and UL128 genes are highly conserved among field solates", Archives of Virology 151(6): 1225-1233 (2006).
Baldwin, J., et al., "A Role for 3-O-Sulfated Heparan Sulfate in Promoting Human Cytomegalovirus Infection in Human Iris Cells", Journal of Virology 89(9):5185-5192 (2015).
Barry, P., "Exploiting viral natural history for vaccine development", Medical Microbiology Immunology 204(3):255-262 (2015).
Bartlett et al, "CAVEAT: A Program to Facilitate the Structure-derived Design of Biologically Active Molecules", Special Publication—Royal Society of Chemistry 78:182-196 (1989).
Beloki, L., et al. "The abrogation of TCR-independent interactions with human serum ensures a selective capture of therapeutic virus-specific CD8+ T-cells by multimer technology in adoptive immunotherapy", Journal of Immunological Methods 396(1-2):168-172 (2013).
Beloki, L., et al. "Manufacturing of CMV-Specific T Cells From G-CSF Mobilised Donors for Adoptive Immunotherapy That Preserve Strong Anti-Viral and Cytotoxic Activity", 16(4):S20, Abstract 49 (2014).
Beloki, L., et al., "CMV-specific T cell isolation from G-CSF mobilized peripheral blood: depletion of myeloid progenitors eliminates non-specific binding of MHC-multimers", Journal of Translational Medicine 12:317 (2014).
Beninga, J., et al., "Comparative analysis of fourteen individual human cytomegalovirus proteins for helper T cell response", Journal of General Virology 76:153-160 (1995).
Berger, I., et al., "Baculovirus expression system for heterologous multiprotein complexes", Nature Biotechnology 22(12):1583-1587 (2004).
Bevan, I., et al., "Investigation of Murine Cytomegalovirus Latency and Reactivation in Mice Using Viral Mutants and the Polymerase Chain Reaction", Journal of Medical Virology 48(4):308-320 (1996).
Binder, T., et al., "Identification of human cytomegalovirus variants by analysis of single strand conformation polymorphism and DNA sequencing of the envelope glycoprotein B gene region-distribution frequency in liver transplant recipients", Journal of Virological Methods 78:153-162 (1999).
Biotechnet: "The Vaccine-Factory in the Box—from vision to reality", Swiss Innovate, Retrieved from the Internet, http://webcache.goofleusercontent.com/search?q=cache:PtrCZH9byBkJ:www.biotechnet.com, 1, 19, 20 (2013).
Bloom et al., "Thiourea inhibitors of herpes viruses. Part 2: N-Benzyl-N'-arylthiourea inhibitors of CMV", Bioorganic & Medicinal Chemistry Letters 14:3401-3406 (2004).
Boccuni, M., et al., "Human cytomegalovirus product UL44 downregulates the transactivation of HIV-1 long terminal repeat", AIDS 12(4):365-372 (1998).
Boeckh, M., et al., "Randomized, Placebo-Controlled, Double-Blind Study of a Cytomegalovirus-Specific Monoclonal Antibody (MSL-109) for Prevention of Cytomegalovirus Infection After Allogeneic Hematopoietic Stem Cell Transplantation", Biology of Blood and Marrow Transplantation 7(6):343-351 (2001).
Boehme, KW., et al., "Human Cytomegalovirus Envelope Glycoproteins B and H are Necessary for TLR2 Activation in Permissive Cells", The Journal of Immunology 177(10):7094-7102 (2006).
Boobbyer et al, "New Hydrogen-Bond Potentials for Use in Determining Energetically Favorable Binding Sites on Molecules of Known Structure", Journal of Medicinal Chemistry 32:1083-1094 (1989).
Boppana, S. et al., "Transplacentally Acquired Antiviral Antibodies and Outcome in Congenital Human Cytomegalovirus Infection", Viral Immunology 9(4)211-218 (1996).
Boppana, S. et al., "Recognition of Human Cytomegalovirus Gene Products by HCMV-Specific Cytotoxic T Cells", Virology 222(1):293-296 (1996).
Borchers, S. et al., "Multimer monitoring of CMV-specific T cells in research and in clinical applications", Diagnostic Microbiolgoy and Infectious Disease 78(3):201-212 (2014).
Bowman, J., et al., "Rhesus and Human Cytomegalovirus Glycoprotein L are Required for Infection and Cell-to-Cell Spread of Virus but Cannot Complement Each Other", Journal of Virology 85(5):2089-2099 (2011).
Brady, R., et al., "Identification and characterization of the guinea-pig cytomegalovirus glycoprotein H gene", Archives of Virology 141(12):2409-2424 (1996).
Brint & Willett, "Pharmacophoric pattern matching in files of 3D chemical structures: comparison of geometric searching algorithms", Journal of Molecular Graphics 5(1):49-56 (1987).
Britt, W., et al., "Human Cytomegalovirus Glycoproteins", Intervirology 39(5-6):401-412 (1996).

(56) References Cited

OTHER PUBLICATIONS

Britt, W., et al., "Human Cytomegalovirus Virion Proteins", Human Immunology 65(5):395-402 (2004).

Bueno, J., et al., "Current Management Strategies for the Prevention and Treatment of Cytomegalovirus Infection in Pediatric Transplant Recipients", Pediatr Drugs 4(5): 279-290 (2002).

Bugg et al, "Drugs by Design", Scientific American 269(6):92-98 (1993).

Burke & Heldwein, "Crystal Structure of the Human Cytomegalovirus Glycoprotein B", PLoS Pathogens 11(10):e1005227(2015).

Buscher, N., et al., "The proteome of human cytomegalovirus virions and dense bodies is conserved across differenct strains", Medical Microbiology and Immunology 204(3):285-293 (2015).

Butcher, S., et al., "Structure of the Human Cytomegalovirus B Capsid by Electron Cryomicroscopy and Image Reconstruction", Journal of Structural Biology, 124:70-76 (1998).

"Cerutti, M., et al., ""Lepidopteran cells: An alternative for the production of recombinant antibodies?"", mAbs 4(3):294-309, DOI: 10.4161/mabs.19942 (2012)".

Chan, Y., et al., "Two Distinct Upstream Regulatory Domains Containing Multicopy Cellular Transcription Factor Binding Sites Provide Basal Repression and Inducible Enhancer Characteristics to the Immediate-Early IE5 (US3) Promoter From Human Cytomegalovirus", Journal of Virology 70(8):5312-5328 (1996).

Chandramouli, S., et al., "Structure of HCMV glycoprotein B in the postfusion conformation bound to a neutralizing human antibody", Nature Communications 6:8176 doi: 10.1038/ncomms9176 (2015).

Chiuppesi, F., et al., "Vaccine-Derived Neutralizing Antibodies to the Human Cytomegalovirus gH/gL Pentamer Potently Block Primary Cytotrophoblast Infection", Journal of Virology 89(23):11884-1198 (2015).

Ohta et al., "Recombinant human monoclonal antibodies to human cytomegalovirus glycoprotein B neutralize virus in a complement-dependant manner", Microbes and Infection 11(13):1029-1036 (2009).

PCT International Search Report and Written Opinion for International Application No. PCT/IB2022/051504 dated Dec. 23, 2022.

Reuter et al., "Cell Fusion Induced by a Fusion-Active Form of Human Cytomegalovirus Glycoprotein B (GB) is inhibited by Antibodies Directed at Antigenic Domain 5 in the Ectodomain of GB", Journal of Virology 94(18):e01276-20 (2020).

Dirks, "Brain Tumor Stem Cells: Bringing Order to the Chaos of Brain Cancer", Journal of Clinical Oncology 26 (17):2916-2924 (2008).

Domingues et al., "Melanoma treatment in review", ImmunoTargets and Therapy 7:35-49 (2018).

López-Lázaro, "The migration ability of stem cells can explain the existence of cancer of unknown primary site. Rethinking metastasis.", Oncoscience 2(5):467-475 (2015).

Mabey, "Epidemiology of sexually transmitted infections: worldwide", Medicine 42(6):287-290 (2014).

Tran and Rosenthal, "Survival comparison between glioblastoma multiforme and other incurable cancers", Journal of Clinical Neuroscience 17(4):417-421 (2010).

Tugizov et al., "Mutated Forms of Human Cytomegalovirus Glycoprotein B are Impaired in Inducing Syncytium Formation", Virology 209:580-591 (1995).

Wang et al., "Silence of MCL-1 upstream signaling by shRNA abrogates multiple myeloma growth", Experimental Hematology & Oncology 3:27 (2014).

Kopp et al., "Proteolytic Cleavage of Bovine Herpesvirus 1 (BHV-1) Glycoprotein gB Is Not Necessary for Its Function in BHV-1 or Pseudorabies Virus", Journal of Virology 68(3): 1667-1674 (1994).

Lopper and Compton, "Disulfide Bond Configuration of Human Cytomegalovirus Glycoprotein B", Journal of Virology 76(12):6073-6082 (2002).

\* cited by examiner 2D projections from a postfusion gB structure 2D class averages

FIG. 2

```
  1 MESRIWCLVV CVNLCIVCLG AAVSSSSTRG TSATHSHHSS HTTSAAHSRS GSVSQRVTSS
    MESRIWCLVV CVNLCIVCLG AAVSSSSTRG TSATHSHHSS HTTSAAHSRS GSVSQRVTSS

61 QTVSHGVNET IYNTTLKYGD VVGVNTTKYP YRVCSMAQGT DLIRFERNIV CTSMKPINED
    QTVSHGVNET IYNTTLKYGD VVGVNTTKYP YRVCSMAQGT DLIRFERNIV CTSMKPINED

121 LDEGIMVVYK RNIVAHTFKV RVYQKVLTFR RSYAYIHTTY LLGSNTEYVA PPMWEIHHIN
    LDEGIMVVYK RNIVAHTFKV RVYQKVLTFR RSYAYIHTTY LLGSNTEYVA PPMWEIHHIN

181 SHSQCYSSYS RVIAGTVFVA YHRDSYENKT MQLMPDDYSN THSTRYVTV K DQWHSRGSTW
    SHSQCYSSYS RVIAGTVFVA YHRDSYENKT MQLMPDDYSN THSTRYVTVK DQWHSRGSTW

241 LYRETCNLNC MVTITTARSK YPYHFFATST GDVVDISPFY NGTNRNASYF GENADKFFIF
    LYRETCNLNC MVTITTARSK YPYHFFATST GDVVDISPFY NGTNRNASYF GENADKFFIF

301 PNYTIVSDFG RPNSALETHR LVAFLERADS VISWDIQDEK NVTCQLTFWE ASERTIRSEA
    PNYTIVSDFG RPNSALETHR LVAFLERADS VISWDIQDEK NVTCQLTFWE ASERTIRSEA

361 EDSYHFSSAK MTATFLSKKQ EVNMSDSALD CVRDEAINKL QQIFNTSYNQ TYEKYGNVSV
    EDSYHFSSAK MTATFLSKKQ EVNMSDSALD CVRDEAINKL QQIFNTSYNQ TYEKYGNVSV

421 FETTGGLVVF WQGIKQKSLV ELERLANRSS LNLTHNRTKR STDGNNATHL SNMESVHNLV
    FETTGGLVVF WQGIKQKSLV ELERLANRSS LNLTHNRTKR STDGNNATHL SNMESVHNLV

481 YAQLQFTYDT LRGYINRALA QIAEAWCVDQ RRTLEVFKEL SKINPSAILS AIYNKPIAAR
    YAQLQFTYDT LRGYINRALA QIAEAWCVDQ RRTLEVFKEL SKINPSAILS AIYNKPIAAR

541 FMGDVLGLAS CVTINQTSVK VLRDMNVKES PGRCYSRPVV IFNFANSSYV QYGQLGEDNE
    FMGDVLGLAS CVTINQTSVK VLRDMNVKES PGRCYSRPVV IFNFANSSYV QYGQLGEDNE

601 ILLGNHRTEE CQLPSLKIFI AGNSAYEYVD YLFKRMIDLS S ISTVDSMIA LDIDPLENTD
    ILLGNHRTEE CQLPSLKIFI AGNSAYEYVD YLFKRMIDLS SISTVDSMIA LDIDPLENTD

661 FRVLELYSQK ELRSSNVFDL EEIMREFNSY KQRVKYVEDK VVDPLPPYLK GLDDLMSGLG
    FRVLELYSQK ELRSSNVFDL EEIMREFNSY KQRVKYVEDK VVDPLPPYLK GLDDLMSGLG

721 AAGKAVGVAI GAVGGAVASV VEGVATFLKN PFGAFTIILV AIAVVIIIYL IYTRQRRLCM
    AAGKAVGVAI GAVGGAVASV VEGVATFLKN PFGAFTIILV AIAVVIIIYL IYTRQRRLCM

781 QPLQNLFPYL VSADGTTVTS GNTKDTSLQA PPSYEESVYN SGRKGPGPPS SDASTAAPPY
    QPLQNLFPYL VSADGTTVTS GNTKDTSLQA PPSYEESVYN SGRKGPGPPS SDASTAAPPY

841 TNEQAYQMLL ALVRLDAEQR AQQNGTDSLD GQTGT QDKGQ KPNLLDRLRH RKNGYRHLKD
    TNEQAYQMLL ALVRLDAEQR AQQNGTDSLD GQTGTQDKGQ KPNLLDRLRH RKNGYRHLKD

901 SDEEENV
    SDEEENV
``` membrane membrane

Prefusion — Extended Intermediate — Postfusion

FIG. 7A FIG. 7B
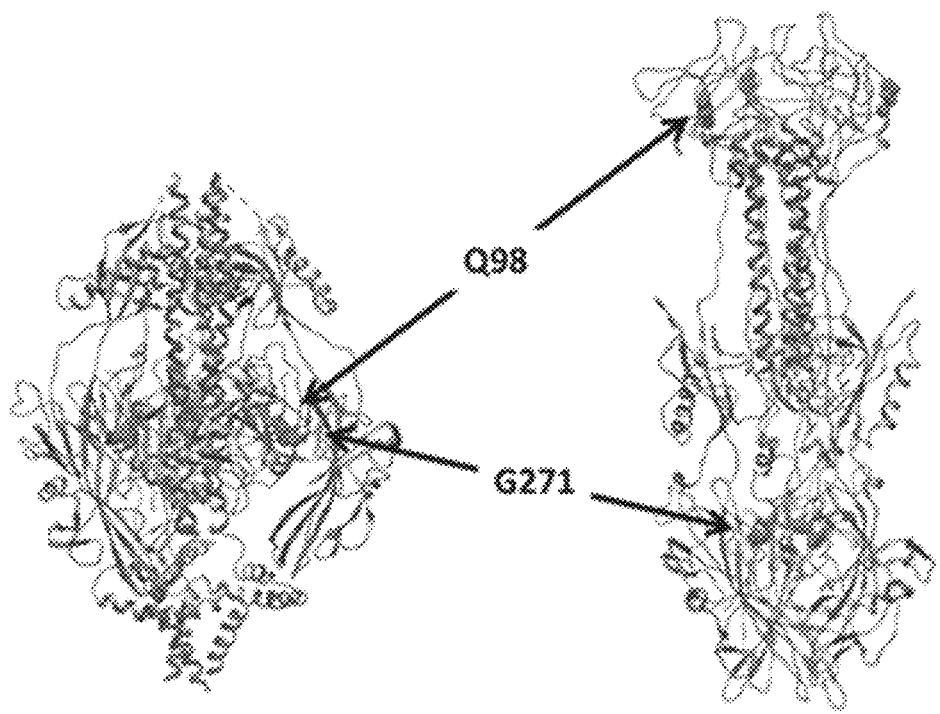

FIG. 8

>5CXF:A|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 107)

>5CXF:B|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 108)

>5CXF:C|PDBID|CHAIN|SEQUENCE
YGDVVGVNTTKYPYRVCSMAQGTDLIRFERNIICTSMKPINEDLDEGIMVVYKRNIVAHTFKVRVYQKVLTFRRSYAGHR
TTYLLGSNTEYVAPPMWEIHHINKFAQCYSSYSRVIGGTVFVAYHRDSHENKTMQLIPDDYSNTHSTRYVTVKDQWHSRG
STATHRETCNLNCMLTITTARSKYPYHFFATSTGDVVYISPFYNGTNRNASYFGENADKFFIFPNYTIVSDFGRPNAAPE
THRLVAFLERADSVISWDIQDEKNVTCQLTFWEASERTIRSEAEDSYHFSSAKMTATFLSKKQEVNMSDSALDCVRDEAI
NKLQQIFNTSYNQTYEKYGNVSVFETSGGLVVFWQGIKQKSLVELERLANRSSLNITHDDDDKSTSDNNTTHLSSMESVH
NLVYAQLQFTYDTLRGYINRALAQIAEAWCVDQRRTLEVFKELSKINPSAILSAIYNKPIAARFMGDVLGLASCVTINQT
SVKVLRDMNVKESPGRCYSRPVVIFNFANSSYVQYGQLGEDNEILLGNHRTEECQLPSLKIFIAGNSAYEYVDYLFKRMI
DLSSISTVDSMIALDIDPLENTDFRVLELYSQKELRSSNVFDLEEIMREFNSYKQRVKYVEDKVVDPLPP (SEQ ID NO: 109)

FIG. 9

>HAN13 gi|242345614|gb|GQ221973.1|:81988-84705 Human
herpesvirus 5 strain HAN13, complete genome reverse complement
MESRIWCLVVCVNLCIVCLGAAVSSSSTSHATSSAHNGSHTSRTTSAQTRSVSSQHVTSS
EAVSHRANETIYNTTLKYGDVVGVNTTKYPYRVCSMAQGTDLIRFERNIVCTPMKPINED
LDEGIMVVYKRNIVAHTFKVRVYQKVLTFRRSYAYIHTTYLLGSNTEYVAPPMWEIHHIN
RHSQCYSSYSRVIAGTVFVAYHRDSYENKTMQLMLDDYSNTHSTRYVTVKDQWHSRGSTW
LYRETCNLNCMVTITTARSKYPYHFFATSTGDVVDISPFYNGTNRNTSYFGENADKFFIF
PNYTIVSDFGRANSAPETHRLVAFLERADSVISWDIQDEKNVTCQLTFWEASERTIRSEA
EDSYHFSSAKMTATFLSKKQEVNMSDPVLDCVRDQALNKLQQIFNASYNQTYEKYGNVSV
FETTGGLVVFWQGIKQKSLLELERLANSSGVNSTRRTKRSTGNTTTLSLESESVRNVLYA
QLQFTYDTLRSYINRALAQIAEAWCVDQRRTLEVFKELSKINPSAILSAIYNKPIAARFM
GDVLGLASCVTINQTSVKVLRDMNVKESPGRCYSRPVVIFNFVNSSYVQYGQLGEDNEIL
LGNHRTEECQFPSLKIFIAGNSAYEYVDYLFKRMIDLSSISTVDSMIALDIDPLENTDFR
VLELYSQKELRSSNVFDLEEIMREFNSYKQRVKYVEDKVVDPLPPYLKGLDDLMSGLGAA
GKAVGVAIGAVGGAVASVVEGVATFLKNPFGAFTIILVAIAVVIIIYLIYTRQRRLCMQP
LQNLFPYLVSADGTTVTSGNTKDTSLQAPPSYEESVYNSGRKGPGPPSSDASTAAPPYTN
EQAYQMLLALARLDAEQRAQQNGTDSLDGQTGTQDKGQKPNLLDRLRHRKNGYRHLKDSD
EEENV (SEQ ID NO: 110)

>VR1814 gi|270355759|gb|GU179289.1|:81925-84642 Human
herpesvirus 5 strain VR1814, complete genome reverse complement
MESRIWCLVVCVNLCIVCLGAVVSSSSTSHATSSAHNGSHTSRTTSAQTRSVSSQHVTSS
EAVSHRANETIYNTTLKYGDVVGVNTTKYPYRVCSMAQGTDLIRFERNIVCTPMKPINED
LDEGIMVVYKRNIVAHTFKVRVYQKVLTFRRSYAYIHTTYLLGSNTEYVAPPMWEIHHIN
RHSQCYSSYSRVIAGTVFVAYHRDSYENKTMQLMLDDYSNTHSTRYVTVKDQWHSRGSTW
LYRETCNLNCMVTITTARSKYPYHFFATSTGDVVDISPFYNGTNRNTSYFGENADKFFIF
PNYTIVSDFGRANSAPETHRLVAFLERADSVISWDIQDEKNVTCQLTFWEASERTIRSEA
EDSYHFSSAKMTATFLSKKQEVNMSDPVLDCVRDQALNKLQQIFNASYNQTYEKYGNVSV
FETTGGLVVFWQGIKQKSLLELERLANSSGVNSTRRTKRSTGNTTTLSLESESVRNVLYA
QLQFTYDTLRSYINRALAQIAEAWCVDQRRTLEVFKELSKINPSAILSAIYNKPIAARFM
GDVLGLASCVTINQTSVKVLRDMNVKESPGRCYSRPVVIFNFVNSSYVQYGQLGEDNEIL
LGNHRTEECQFPSLKIFIAGNSAYEYVDYLFKRMIDLSSISTVDSMIALDIDPLENTDFR
VLELYSQKELRSSNVFDLEEIMREFNSYKQRVKYVEDKVVDPLPPYLKGLDDLMSGLGAA
GKAVGVAIGAVGGAVASVVEGVATFLKNPFGAFTIILVAIAVVIIIYLIYTRQRRLCMQP
LQNLFPYLVSADGTTVTSGNTKDTSLQAPPSYEESVYNSGRKGPGPPSSDASTAAPPYTN
EQAYQMLLALARLDAEQRAQQNGTDSLDGQTGTQDKGQKPNLLDRLRHRKNGYRHLKDSD
EEENV (SEQ ID NO: 111)

FIG. 10

Original HCMV gB (Towne) sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 1)
``` gB-001 Q98C, G271C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST CDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 2)
```

FIG. 10 (Continued)

gB-002 Q98C, I653C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 3)
``` gB-003 G99C, A267C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQCT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFCTST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 4)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFCTST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 5)
``` gB-005 T100C, S269C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 6)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA CDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 7)
``` gB-007 D217C, F584C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNCANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 8)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDCSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFCNSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 9)
``` gB-009 S219C, D654C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDICPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 10)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSC THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 11)
``` gB-011 T221C, D652C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN CHSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 12)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSCLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 13)
``` gB-013 Y242C, K710C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLC GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 14)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDCLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 15)
``` gB-015 S269C, I653C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 16)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST CDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLCSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 17)
``` gB-017 S367C, L499C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRACA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 18)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MCATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEACCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 19)
``` gB-019 F541C, Q669C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 CMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSCK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 20)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGCAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIC LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 21)
``` gB-021 A549C, I653C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLCS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDCDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 22)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LCIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 23)
``` gB-023 G604C, F661C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLCNHRTEE CQLPSLKIFI AGNSAYEYVD YLFKRMIDLS SISTVDSMIA LDIDPLENTD
661 CRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 24)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGCHRTEE CQLPSLKIFI AGNSAYEYVD YLFKRMIDLS SISTVDSMIA LDIDPLENTD
661 FRVLCLYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 25)
``` gB-025 R607C, S675C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHCTEE CQLPSLKIFI AGNSAYEYVD YLFKRMIDLS SISTVDSMIA LDIDPLENTD
661 FRVLELYSQK ELRSCNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 26)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRCEE CQLPSLKIFI AGNSAYEYVD YLFKRMIDLS SISTVDSMIA LDIDPLENTD
661 FRVLELYSQK ELRSSNVFCL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 27)
``` gB-027 E609C, F678C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTCE CQLPSLKIFI AGNSAYEYVD YLFKRMIDLS SISTVDSMIA LDIDPLENTD
661 FRVLELYSQK ELRSSNVCDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 28)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELCCSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 29)
``` gB-029 N676C, V677C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSCCFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 30)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC CEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 31)
``` gB-031 I683C, M684C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECCREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 32)
```

FIG. 10 (Continued)

gB-032 F687C, N688C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRECCSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 33)
``` gB-033 Y690C, K691C
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSC CQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 34)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVCYVEDK VVDPLPPYLK GLDDLMSGLG
721 AAGCAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 35)
``` gB-035 T746C, F747C

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVACCLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 36)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLCC PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 37)
``` gB-037 K670L

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQL ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 38)
```

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQF ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 39)
``` gB-039 R673L

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELLSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 40)
```

1 MESRIWCLVV CVNLCIVCLG AAVSSSSTRG TSATHSHHSS HTTSAAHSRS GSVSQRVTSS
     61 QTVSHGVNET IYNTTLKYGD VVGVNTTKYP YRVCSMAQGT DLIRFERNIV CTSMKPINED
    121 LDEGIMVVYK RNIVAHTFKV RVYQKVLTFR RSYAYIHTTY LLGSNTEYVA PPMWEIHHIN
    181 SHSQCYSSYS RVIAGTVFVA YHRDSYENKT MQLMPDDYSN THSTRYVTVK DQWHSRGSTW
    241 LYRETCNLNC MVTITTARSK YPYHFFATST GDVVDISPFY NGTNRNASYF GENADKFFIF
    301 PNYTIVSDFG RPNSALETHR LVAFLERADS VISWDIQDEK NVTCQLTFWE ASERTIRSEA
    361 EDSYHFSSAK MTATFLSKKQ EVNMSDSALD CVRDEAINKL QQIFNTSYNQ TYEKYGNVSV
    421 FETTGGLVVF WQGIKQKSLV ELERLANRSS LNLTHNRTKR STDGNNATHL SNMESVHNLV
    481 YAQLQFTYDT LRGYINRALA QIAEAWCVDQ RRTLEVFKEL SKINPSAILS AIYNKPIAAR
    541 FMGDVLGLAS CVTINQTSVK VLRDMNVKES PGRCYSRPVV IFNFANSSYV QYGQLGEDNE
    601 ILLGNHRTEE CQLPSLKIFI AGNSAYEYVD YLFKRMIDLS SISTVDSMIA LDIDPLENTD
    661 FRVLELYSQK ELFSSNVFDL EEIMREFNSY KQRVKYVEDK VVDPLPPYLK GLDDLMSGLG
    721 AAGKAVGVAI GAVGGAVASV VEGVATFLKN PFGAFTIILV AIAVVIIIYL IYTRQRRLCM
    781 QPLQNLFPYL VSADGTTVTS GNTKDTSLQA PPSYEESVYN SGRKGPGPPS SDASTAAPPY
    841 TNEQAYQMLL ALVRLDAEQR AQQNGTDSLD GQTGTQDKGQ KPNLLDRLRH RKNGYRHLKD
    901 SDEEENV (SEQ ID NO: 41)

gB-041 K691L

1 MESRIWCLVV CVNLCIVCLG AAVSSSSTRG TSATHSHHSS HTTSAAHSRS GSVSQRVTSS
     61 QTVSHGVNET IYNTTLKYGD VVGVNTTKYP YRVCSMAQGT DLIRFERNIV CTSMKPINED
    121 LDEGIMVVYK RNIVAHTFKV RVYQKVLTFR RSYAYIHTTY LLGSNTEYVA PPMWEIHHIN
    181 SHSQCYSSYS RVIAGTVFVA YHRDSYENKT MQLMPDDYSN THSTRYVTVK DQWHSRGSTW
    241 LYRETCNLNC MVTITTARSK YPYHFFATST GDVVDISPFY NGTNRNASYF GENADKFFIF
    301 PNYTIVSDFG RPNSALETHR LVAFLERADS VISWDIQDEK NVTCQLTFWE ASERTIRSEA
    361 EDSYHFSSAK MTATFLSKKQ EVNMSDSALD CVRDEAINKL QQIFNTSYNQ TYEKYGNVSV
    421 FETTGGLVVF WQGIKQKSLV ELERLANRSS LNLTHNRTKR STDGNNATHL SNMESVHNLV
    481 YAQLQFTYDT LRGYINRALA QIAEAWCVDQ RRTLEVFKEL SKINPSAILS AIYNKPIAAR
    541 FMGDVLGLAS CVTINQTSVK VLRDMNVKES PGRCYSRPVV IFNFANSSYV QYGQLGEDNE
    601 ILLGNHRTEE CQLPSLKIFI AGNSAYEYVD YLFKRMIDLS SISTVDSMIA LDIDPLENTD
    661 FRVLELYSQK ELRSSNVFDL EEIMREFNSY LQRVKYVEDK VVDPLPPYLK GLDDLMSGLG
    721 AAGKAVGVAI GAVGGAVASV VEGVATFLKN PFGAFTIILV AIAVVIIIYL IYTRQRRLCM
    781 QPLQNLFPYL VSADGTTVTS GNTKDTSLQA PPSYEESVYN SGRKGPGPPS SDASTAAPPY
    841 TNEQAYQMLL ALVRLDAEQR AQQNGTDSLD GQTGTQDKGQ KPNLLDRLRH RKNGYRHLKD
    901 SDEEENV (SEQ ID NO: 42)

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY FQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 43)
``` gB-043 M96C, D660C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSCAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTC
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 47)
```

FIG. 10 (Continued)

gB-044 Q98C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMACGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 48)
``` gB-045 T100C, R258C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTACSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 49)
```

FIG. 10 (Continued)

gB-046 T100C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 50)
``` gB-047 T100C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGC DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 51)
```

FIG. 10 (Continued)

gB-048 I117C, T406C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPCNED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNCSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 52)
``` gB-049 I117C, S407C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPCNED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTCYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 53)
```

FIG. 10 (Continued)

gB-050 Y153C, L712C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSCAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GCDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 54)
``` gB-051 L162C, M716C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LCGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLCSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 55)
```

FIG. 10 (Continued)

gB-052 D217C, S587C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANCSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 56)
``` gB-053 D217C, Y589C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDCYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSCV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 57)
```

FIG. 10 (Continued)

gB-054 S219C, F584C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNCANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 58)
``` gB-055 S219C, A585C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFCNSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 59)
```

FIG. 10 (Continued)

gB-056 S219C, N586C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYCN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFACSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 60)
``` gB-057 N220C, T659C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSC THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENCD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 61)
```

FIG. 10 (Continued)

gB-058 S223C, T659C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THCTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENCD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 62)
``` gB-059 W240C, A732C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GCVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 63)
```

FIG. 10 (Continued)

gB-060 W240C, G735C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTC
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGCAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 64)
``` gB-061 Y242C, V728C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGCAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 65)
```

FIG. 10 (Continued)

gB-062 Y242C, G731C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LCRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI CAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 66)
``` gB-063 R258C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTACSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 67)
```

FIG. 10 (Continued)

gB-064 S269C, L656C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPCENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 68)
``` gB-065 S269C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATCT GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 69)
```

FIG. 10 (Continued)

gB-066 D272C, P614C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GCVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLCSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 70)
``` gB-067 V273C, V629C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDCVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYCD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 71)
```

FIG. 10 (Continued)

gB-068 W349C, A650C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFCE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIC LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 72)
``` gB-069 S367C, A500C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALC QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 73)
```

FIG. 10 (Continued)

gB-070 S367C, A503C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFCSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QICEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 74)
``` gB-071 K370C, Q501C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAC MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA CIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 75)
```

FIG. 10 (Continued)

gB-072 K522C, I683C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SCINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 76)
``` gB-073 I523C, I683C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKCNPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EECMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 77)
```

FIG. 10 (Continued)

gB-074 I523C, M684C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKCNPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEICREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 78)
``` gB-075 N524C, M684C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKICPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEICREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 79)
```

FIG. 10 (Continued)

gB-076 P525C, E681C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINCSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL CEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 80)
``` gB-077 R540C, L680C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAC
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 81)
```

FIG. 10 (Continued)

gB-078 F541C, L680C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 CMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDC EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 82)
``` gB-079 L548C, P655C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGCAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDCLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 83)
```

FIG. 10 (Continued)

gB-080 A549C, N658C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLCS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLECTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 84)
``` gB-081 S550C, P655C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDCLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 85)
```

FIG. 10 (Continued)

gB-082 S550C, E657C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAC CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLCNTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 86)
``` gB-083 Q591C, S668C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV CYGQLGEDNE
601 ILLGNHRTEE CQLPSLKIFI AGNSAYEYVD YLFKRMIDLS SISTVDSMIA LDIDPLENTD
661 FRVLELYCQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 87)
```

FIG. 10 (Continued)

gB-084 L603C, Y667C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILCGNHRTEE CQLPSLKIFI AGNSAYEYVD YLFKRMIDLS SISTVDSMIA LDIDPLENTD
661 FRVLELCSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 88)
``` gB-085 G604C, L672C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLCNHRTEE CQLPSLKIFI AGNSAYEYVD YLFKRMIDLS SISTVDSMIA LDIDPLENTD
661 FRVLELYSQK ECRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 89)
```

FIG. 10 (Continued)

gB-086 R607C, N688C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHCTEE CQLPSLKIFI AGNSAYEYVD YLFKRMIDLS SISTVDSMIA LDIDPLENTD
661 FRVLELYSQK ELRSSNVFDL EEIMREFCSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 90)
``` gB-087 T608C, Q692C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRCEE CQLPSLKIFI AGNSAYEYVD YLFKRMIDLS SISTVDSMIA LDIDPLENTD
661 FRVLELYSQK ELRSSNVFDL EEIMREFNSY KCRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 91)
```

FIG. 10 (Continued)

gB-088 E609C, K691C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTCE CQLPSLKIFI AGNSAYEYVD YLFKRMIDLS SISTVDSMIA LDIDPLENTD
661 FRVLELYSQK ELRSSNVFDL EEIMREFNSY CQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 92)
``` gB-089 E610C, S674C sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEC CQLPSLKIFI AGNSAYEYVD YLFKRMIDLS SISTVDSMIA LDIDPLENTD
661 FRVLELYSQK ELRCSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 93)
```

FIG. 10 (Continued)

gB-090 E610C, S675C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEC CQLPSLKIFI AGNSAYEYVD YLFKRMIDLS SISTVDSMIA LDIDPLENTD
661 FRVLELYSQK ELRSCNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 94)
``` gB-091 Q612C, V663C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CCLPSLKIFI AGNSAYEYVD YLFKRMIDLS SISTVDSMIA LDIDPLENTD
661 FRCLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 95)
```

FIG. 10 (Continued)

gB-092 V737C, F755C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGACASV VEGVATFLKN PFGACTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 96)
``` gB-093 V741C, A754C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV CEGVATFLKN PFGCFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 97)
```

FIG. 10 (Continued)

gB-094 V741C, F755C sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV CEGVATFLKN PFGACTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 98)
``` gB-095 D679S sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFSL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 99)
```

FIG. 10 (Continued)

gB-096 D679N sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFNL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 100)
``` gB-097 E682S sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL ESIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 101)
```

FIG. 10 (Continued)

gB-098 E682Q sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EQIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 102)
``` gB-099 E686S sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRSFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 103)
```

FIG. 10 (Continued)

gB-100 E686Q sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMRQFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 104)
``` gB-101 N118P sequence
```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPIPED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVDSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 105)
```

FIG. 10 (Continued)

gB-102 D646P sequence

```
  1 MESRIWCLVV CVNLCIVCLG AAVSSSSTRG TSATHSHHSS HTTSAAHSRS GSVSQRVTSS
 61 QTVSHGVNET IYNTTLKYGD VVGVNTTKYP YRVCSMAQGT DLIRFERNIV CTSMKPINED
121 LDEGIMVVYK RNIVAHTFKV RVYQKVLTFR RSYAYIHTTY LLGSNTEYVA PPMWEIHHIN
181 SHSQCYSSYS RVIAGTVFVA YHRDSYENKT MQLMPDDYSN THSTRYVTVK DQWHSRGSTW
241 LYRETCNLNC MVTITTARSK YPYHFFATST GDVVDISPFY NGTNRNASYF GENADKFFIF
301 PNYTIVSDFG RPNSALETHR LVAFLERADS VISWDIQDEK NVTCQLTFWE ASERTIRSEA
361 EDSYHFSSAK MTATFLSKKQ EVNMSDSALD CVRDEAINKL QQIFNTSYNQ TYEKYGNVSV
421 FETTGGLVVF WQGIKQKSLV ELERLANRSS LNLTHNRTKR STDGNNATHL SNMESVHNLV
481 YAQLQFTYDT LRGYINRALA QIAEAWCVDQ RRTLEVFKEL SKINPSAILS AIYNKPIAAR
541 FMGDVLGLAS CVTINQTSVK VLRDMNVKES PGRCYSRPVV IFNFANSSYV QYGQLGEDNE
601 ILLGNHRTEE CQLPSLKIFI AGNSAYEYVD YLFKRMIDLS SISTVPSMIA LDIDPLENTD
661 FRVLELYSQK ELRSSNVFDL EEIMREFNSY KQRVKYVEDK VVDPLPPYLK GLDDLMSGLG
721 AAGKAVGVAI GAVGGAVASV VEGVATFLKN PFGAFTIILV AIAVVIIIYL IYTRQRRLCM
781 QPLQNLFPYL VSADGTTVTS GNTKDTSLQA PPSYEESVYN SGRKGPGPPS SDASTAAPPY
841 TNEQAYQMLL ALVRLDAEQR AQQNGTDSLD GQTGTQDKGQ KPNLLDRLRH RKNGYRHLKD
901 SDEEENV (SEQ ID NO: 106)
```

D703C, P704C

GCN4
Trimerization
motif

T4 fibritin
foldon gB2555 GCN4 1666
+(M371,W506)

◯ Prefusion like, tapered shape  ▢ Postfustion domain feature gB2556 GCN4 1666
+(N524,M684)

HUMAN CYTOMEGALOVIRUS GB POLYPEPTIDE

RELATED APPLICATIONS

This application claims priority to U.S. Provisional Application No. 63/041,945 filed Jun. 21, 2020 and U.S. Provisional Application No. 63/208,457 filed Jun. 8, 2021. The entire content of each of the foregoing applications is herein incorporated by reference in its entirety.

REFERENCE TO SEQUENCE LISTING

This application is being filed electronically via EFS-Web and includes an electronically submitted sequence listing in .txt format. The .txt file contains a sequence listing entitled "PC72639_June2021_ST25.txt" created on Jun. 7, 2021 and having a size of 1,427 KB. The sequence listing contained in this .txt file is part of the specification and is herein incorporated by reference in its entirety.

FIELD OF THE INVENTION

The present invention relates to human cytomegalovirus (HCMV) compositions and methods thereof.

BACKGROUND OF THE INVENTION

Human cytomegalovirus (HCMV) is a double stranded DNA virus of the 3-herpesvirus family. HCMV is the leading cause of congenital and neonatal hearing loss resulting from vertical virus transmission following infection or reactivation of latent virus in pregnant women. In addition, HCMV is a common opportunistic pathogen affecting immunosuppressed patients, such as solid organ and stem cell transplant patients, AIDS patients, etc. Though development of a vaccine against HCMV has been listed as a top priority by the Institute of Medicine, none has been licensed to date.

The HCMV genome encodes several envelope glycoproteins, one of which is glycoprotein B (gB). Glycoprotein B is a fusogen that is required for virus entry into cells and an important target for neutralizing antibody (nAb) responses to infection. HCMV vaccines that incorporate gB subunit antigens have been under development. Clinical studies have shown that some gB subunit-based vaccine candidates are safe and immunogenic, though improvements in protective efficacy and durability of protection are desirable.

Accordingly, safe and effective immunogenic compositions to protect against HCMV infection are needed. Diagnostic reagents to detect immune responses to HCMV, to guide the design of gB-based HCMV vaccines, and to support the development of therapeutic or prophylactic antibodies against HCMV are also needed.

SUMMARY OF THE INVENTION

To meet these and other needs, in one aspect, the present invention relates to a polypeptide that may be included in an immunogenic composition as an antigen to elicit an immune response to HCMV.

This invention provides a mutant of a wild-type cytomegalovirus (CMV) glycoprotein B (gB) protein, which mutant comprises at least two amino acid mutations relative to the amino acid sequence of the wild-type CMV gB protein, and wherein the amino acid mutation is selected from the group consisting of:

(1) an engineered disulfide bond mutation;
(2) an additional mutation; and
(3) a combination of at least one engineered disulfide mutation and at least one additional mutation.

In one aspect, the amino acid mutations comprise a combination of at least two engineered disulfide mutations and at least one additional mutation. In another aspect, the mutant of a wild-type CMV gB protein is in the form of a trimer.

In another aspect of the invention, the engineered disulfide mutation is selected from the group consisting of: D217C and Y589C; M371C and W506C; and N524C and M684C.

In a further aspect of the invention, the additional mutation is selected from the group consisting of:

(1) substitution of YIH at positions 155-157 with GHR;
(2) substitution of W at position 240 with A;
(3) substitution of C at position 246 with S;
(4) substitution of P at position 655 with S;
(5) substitution of F at position 678 with S; and
(6) substitution of L at position 680 with T;
(7) substitution of R at position 685 with A;
(8) substitution of MIALDI at positions 648-653 with GSGKDG;
(9) substitution of R at position 693 with V;
(10) substitution of I at position 675 with S;
(11) substitution of I at positions 767 and 768 with C;
(12) substitution of D at position 703 and P at position 704 with C; and
(13) substitution of Y at position 696 and V at position 697 with C.

In another aspect of the invention, the mutant is secreted. In another aspect of the invention, the mutant is soluble.

This invention also provides a pharmaceutical composition comprising (i) a CMV gB protein mutant according to the embodiments and aspects described herein and (ii) a pharmaceutically acceptable carrier. In one aspect, the pharmaceutical composition is a vaccine.

This invention also provides a method of reducing CMV infection in a subject comprising administering to the subject an effective amount of the vaccine set forth in the embodiments herein.

This invention also provides a method of eliciting an immune response to CMV infection in a subject comprising administering to the subject an effective amount of the vaccine set forth in the embodiments herein.

This invention also provides a method of preventing CMV infection in a subject comprising administering to the subject an effective amount of the vaccine set forth in the embodiments herein.

In another aspect, the invention relates to a polypeptide including at least one introduced amino acid mutation relative to the amino acid sequence of the wild-type HCMV glycoprotein B (gB). In some embodiments, the polypeptide includes a conformation that is not an HCMV gB postfusion conformation.

In another aspect, the invention relates to a polypeptide that binds to an HCMV gB prefusion-specific antibody.

In another aspect, the invention relates to a polypeptide that binds to a bis(aryl)thiourea compound. In some embodiments, the compound is N-{4-[({(1S)-1-[3,5-bis(trifluoromethyl)phenyl]ethyl}carbamothioyl)amino]phenyl}-1,3-thiazole-4-carboxamide.

In some embodiments, the polypeptide is characterized by structure coordinates including a root mean square deviation (RMSD) of conserved residue backbone atoms when superimposed on backbone atoms described by structural coordinates of Table 1A, i.e., pdb file, "Table1A-prefusion_gB_121918 pdb," which is incorporated herein by reference in its entirety.

In some embodiments, the polypeptide is characterized by structure coordinates including a root mean square deviation (RMSD) of conserved residue backbone atoms when superimposed on backbone atoms described by structural coordinates of Table 1B, i.e., the pdb file, "Table1B-refine_apply_ncs_14 pdb," which is incorporated herein by reference in its entirety.

In one aspect, the invention relates to a polypeptide including at least one amino acid mutation relative to the amino acid sequence of the wild-type HCMV gB polypeptide, wherein the amino acid mutation includes a cysteine substitution.

In another aspect, the invention relates to a polypeptide including at least one amino acid mutation relative to the amino acid sequence of the wild-type HCMV gB polypeptide, wherein the amino acid mutation includes a mutation that allows a disulfide bond to form.

In another aspect, the invention relates to a polypeptide including at least one amino acid mutation relative to the amino acid sequence of the wild-type HCMV gB polypeptide, wherein the amino acid mutation includes an electrostatic mutation.

In another aspect, the invention relates to a polypeptide including at least one amino acid mutation relative to the amino acid sequence of the wild-type HCMV gB polypeptide, wherein the amino acid mutation includes a phenylalanine substitution.

In another aspect, the invention relates to a polypeptide including at least one amino acid mutation relative to the amino acid sequence of the wild-type HCMV gB polypeptide, wherein the amino acid mutation includes a leucine substitution.

In another aspect, the invention relates to a polypeptide including at least one amino acid mutation relative to the amino acid sequence of the wild-type HCMV gB polypeptide, wherein the mutation stabilizes prefusion conformation of the polypeptide, and wherein the polypeptide specifically binds to an HCMV gB prefusion-specific antibody.

In another aspect, the invention relates to a polypeptide including a cysteine at any one of the amino acid positions listed in column (ii) of Table 2, as compared to SEQ ID NO: 1.

In another aspect, the invention relates to a polypeptide including an amino acid substitution at any one of the amino acid positions listed in column (ii) of Table 3, as compared to SEQ ID NO: 1.

In another aspect, the invention relates to a polypeptide including the mutations Q98C and I653C according to the numbering of SEQ ID NO: 1. In another aspect, the invention relates to a polypeptide including the mutations T100C and S269C according to the numbering of SEQ ID NO: 1. In another aspect, the invention relates to a polypeptide including the mutations D217C and F584C according to the numbering of SEQ ID NO: 1. In another aspect, the invention relates to a polypeptide including the mutations Y242C and K710C according to the numbering of SEQ ID NO: 1. In another aspect, the invention relates to a polypeptide including the mutations Y242C and D714C according to the numbering of SEQ ID NO: 1. In another aspect, the invention relates to a polypeptide including the mutations S367C and L499C according to the numbering of SEQ ID NO: 1. In another aspect, the invention relates to a polypeptide including the mutations T372C and W506C according to the numbering of SEQ ID NO: 1. In another aspect, the invention relates to a polypeptide including the mutations S550C and D652C according to the numbering of SEQ ID NO: 1. In another aspect, the invention relates to a polypeptide including the mutations T608C and D679C according to the numbering of SEQ ID NO: 1. In another aspect, the invention relates to a polypeptide including the mutations K695C and K724C according to the numbering of SEQ ID NO: 1. In another aspect, the invention relates to a polypeptide including an amino acid sequence that is at least about 90% identical to the amino acid sequence set forth in any one of SEQ ID NOs: 1-43, wherein the polypeptide includes a mutation as compared to SEQ ID NO: 1.

In some embodiments, the polypeptide does not include a mutation at any one of the following positions: R562, P577, S587, Y588, G592, G595, L601/H605, C610, L612, P613, Y625, Y627, F632, and K633.

In some embodiments, the polypeptide does not include the cytoplasmic tail of HCMV gB. In some embodiments, the polypeptide does not include the transmembrane region. In some embodiments, the polypeptide includes the cytoplasmic tail of HCMV gB and does not include the transmembrane region.

In some embodiments, the polypeptide does not contain an insect cell pattern of glycosylation.

In some embodiments, the polypeptide exhibits improved solubility or stability, as compared to a native gB in a postfusion conformation.

In some embodiments, the polypeptide is immunogenic.

In another aspect, the invention relates to a nucleic acid encoding the polypeptide according to any one of embodiments described herein. In some embodiments, the nucleic acid includes a self-replicating RNA molecule. In some embodiments, the nucleic acid includes a modified RNA molecule. In another aspect, the invention relates to a composition including a nucleic acid according to any one of the embodiments described herein.

In another aspect, the invention relates to a composition including the polypeptide according to any one of embodiments described herein, and further including a CMV antigen. In some embodiments, the composition further includes any one of the following polypeptides: gO, gH, gL, pUL128, pUL130, pUL131, and any combination thereof. In some embodiments, the composition further includes a diluent. In some embodiments, the composition further includes an adjuvant. In some embodiments, the composition is immunogenic. In some embodiments, the composition is for use in eliciting an immune response against cytomegalovirus.

In another aspect, the invention relates to a method of eliciting an immune response in a mammal. The method includes administering to the mammal an effective amount of the polypeptide according to any one of the embodiments described herein.

In another aspect, the invention relates to a method for reducing cytomegalovirus viral shedding in a mammal. The method includes administering to the mammal an effective amount of the polypeptide according to any one of the embodiments described herein.

In another aspect, the invention relates to a composition including a polynucleotide that may elicit an immune response in a mammal. The polynucleotide encodes at least one polypeptide of interest, e.g., an antigen. Antigens disclosed herein may be wild type (i.e., derived from the infectious agent) or preferably modified (e.g., engineered, designed or artificial). The nucleic acid molecules described herein, specifically polynucleotides, in some embodiments, encode one or more peptides or polypeptides of interest. Such peptides or polypeptides may serve as an antigen or antigenic molecule. The term "nucleic acid" includes any compound that includes a polymer of nucleotides. These polymers are referred to as "polynucleotides." Exemplary nucleic acids or polynucleotides of the invention include, but are not limited to, ribonucleic acids (RNAs), including mRNA, and deoxyribonucleic acids (DNAs).

In some embodiments, the composition includes DNA encoding a polypeptide or fragment thereof described herein. In some embodiments, the composition includes RNA encoding a polypeptide or fragment thereof described herein. In some embodiments, the composition includes an mRNA polynucleotide encoding a polypeptide or fragment thereof described herein. Such compositions may produce the appropriate protein conformation upon translation.

In one aspect, the invention relates to a composition that includes at least one polynucleotide encoding a polypeptide including at least one amino acid mutation relative to the amino acid sequence of the wild-type HCMV gB.

In some embodiments, the invention relates to a composition that includes at least one polynucleotide encoding at least one hCMV gB polypeptide or an immunogenic fragment or epitope thereof.

In some embodiments, the composition includes at least one polynucleotide encoding two or more additional polypeptides or an immunogenic fragment or epitope thereof. In some embodiments, the composition includes two or more polynucleotides encoding two or more additional polypeptides or immunogenic fragments or epitopes thereof. The one or more additional polypeptides may be encoded on a single polynucleotide or may be encoded individually on multiple (e.g., two or more) polynucleotides.

In another aspect, the invention relates to a composition that includes (a) a polypeptide including at least one introduced amino acid mutation relative to the amino acid sequence of the wild-type HCMV glycoprotein B (gB); and (b) an additional polypeptide, preferably an HCMV polypeptide, more preferably an HCMV antigenic polypeptide. The additional polypeptide may be selected from gH, gL, gB, gO, gN, and gM and an immunogenic fragment or epitope thereof. In some embodiments, the additional polypeptide is pp65. In some embodiments, the additional polypeptide may be selected from gH, gL, gO, gM, gN, UL128, UL130, and UL131A, and fragments thereof. In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide, preferably an HCMV antigenic polypeptide. The additional polypeptide may be selected from HCMV gH, gL, gB, gO, gN, and gM and an immunogenic fragment or epitope thereof. In some embodiments, the additional polypeptide is HCMV pp65. In some embodiments, the additional polypeptide may be selected from HCMV gH, gL, gO, gM, gN, UL128, UL130, and UL131A, and fragments thereof.

In another aspect, the invention relates to methods of inducing an immune response in a mammal, including administering to the mammal a composition in an amount effective to induce an immune response, wherein the composition includes a polynucleotide encoding a polypeptide including at least one introduced amino acid mutation relative to the amino acid sequence of the wild-type HCMV gB. The composition disclosed herein may be formulated in an effective amount to produce an antigen specific immune response in a mammal.

BRIEF DESCRIPTION OF THE DRAWINGS

FIG. 1A depicts the 2D projections from a postfusion gB structure. Projection images of an electron cryomicroscopy structure of postfusion gB bound with antibody Fabs are shown. FIG. 1B depicts 2D class averages. Two-dimensional class averages from electron cryomicroscopy images obtained from a preparation of gB extracted from CMV virions after treatment with a fusion inhibitor and a cross-linker and binding of an antibody fragment are shown on the right. Class averaged images that do not resemble any of the reference postfusion gB two dimensional projections are identified by circles.

FIG. 2 describes glycoprotein B amino acids included in the prefusion and postfusion gB-Fab complex models from our electron cryomicroscopy structures. The amino acids that can be modeled in the electron cryomicroscopy density maps are highlighted with the domain color codes (Domain I (italics only, i.e., upper sequence (prefusion) residues 133-344; lower sequence (post-fusion) residues 133-344); Domain II (bold and underlined, i.e., upper sequence (prefusion) residues 121-132 and 345-436; lower sequence (post-fusion) residues 121-132 and 345-439); Domain III (bold only, i.e., upper sequence (prefusion) residues 86-120 and 483-550; lower sequence (post-fusion) residues 86-120 and 474-550); Domain IV (italics and underlined, i.e., upper sequence (prefusion) residues 551-641; lower sequence (post-fusion) residues 551-641); Domain V (italics and bold, i.e., upper sequence (prefusion) residues 642-724; lower sequence (post-fusion) residues 642-697); MPR (underline only, i.e., upper sequence (prefusion) residues 25-7507; lower sequence (post-fusion) no residues); TM (italics, bold, and underlined, i.e., upper sequence (prefusion) residues 751-769; lower sequence (post-fusion) no residues)). The upper and lower amino acid sequences are for the prefusion and postfusion structure models, respectively, both having SEQ ID NO: 1.

FIG. 5A depicts the location of fusion inhibitor compound N-{4-[({(1S)-1-[3,5-bis(trifluoromethyl)phenyl]ethyl}carbamothioyl)amino]phenyl}-1,3-thiazole-4-carboxamide in the prefusion gB model is shown in black. The chemical structure of the compound is shown in FIG. 5D. FIG. 5B: A close view of the electron density around the compound (grey transparent surface). Nearby amino acid residues are shown and domains are labeled. FIG. 5C: The interacting residues around the compound are shown.

FIG. 6A (prefusion) depicts a prefusion conformation; FIG. 6B (Extended intermediate) depicts an extended intermediate conformation; FIG. 6C (postfusion) depicts a postfusion conformation.

FIG. 7A-7B depict an exemplary disulfide bond mutation to stabilize gB in a prefusion conformation. The locations of the residues participating in the disulfide bond are depicted as gray spheres in a prefusion conformation (FIG. 7A) and postfusion conformation (FIG. 7B).

FIG. 8 depicts information from Research Collaboratory for Structural Bioinformatics Protein Data Bank (RCSB PDB) file: 5CXF, Crystal structure of the extracellular domain of glycoprotein B from Human Cytomegalovirus, from Human cytomegalovirus (strain AD169), deposited 2015-07-28; DOI: 10.2210/pdb5CXF/pdb.

Unit Cell:
Length (Å) Angle (°)
a=92.183 α=90.00
b=133.930 β=90.00
c=295.376 γ=90.00

FIG. 9 depicts sequences of gB from clinical and laboratory-adapted HCMV strains (SEQ ID NO: 110-SEQ ID NO: 111). Additional sequences may be found in an amino acid sequence alignment of gB from clinical and laboratory-adapted HCMV found in S4 Fig., from Burke et al., PLoS Pathog. 2015 Oct. 20; 11(10):e1005227. According to Burke et al. sixty HCMV gB sequences from clinical and laboratory-adapted strains, downloaded from NCBI's RefSeq data base, were aligned and analyzed using ClustalW2 and ESPript 3.x. Identical residues are shown as white text on red background, and similar residues are highlighted in yellow in S4 Fig. of Burke et al., said S4 Fig. and the description thereof is incorporated herein by reference in its entirety.

FIG. 10 depicts the amino acid sequences for SEQ ID NOs: 1-43 and SEQ ID NOs: 47-106.

Figure 11:
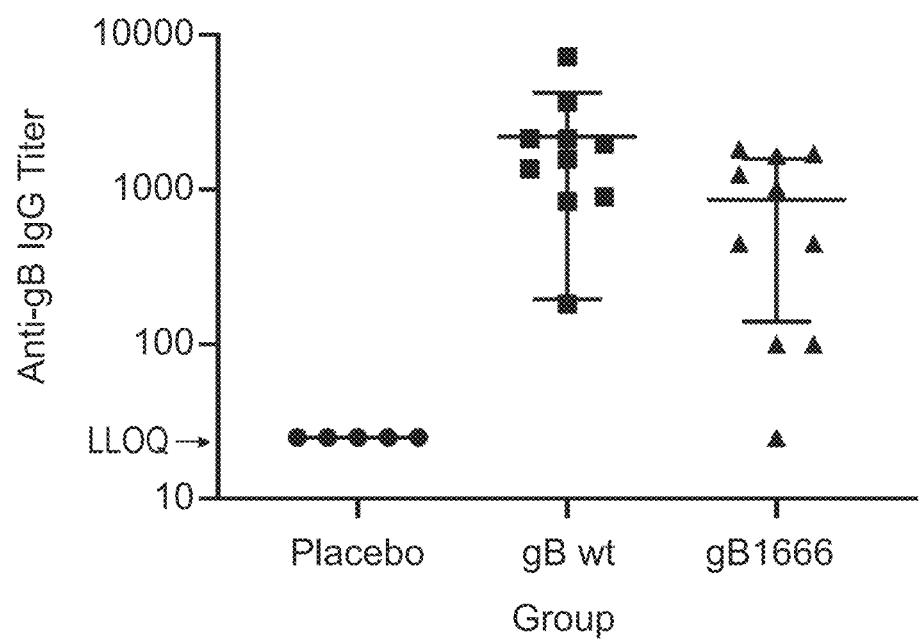

FIG. 11 depicts the dose-dependent IgG responses in both gB1666 and wild type gB (Towne) immunized mice. The graph shows that 10 out of 10 mice immunized with wild type gB DNA, and 9 out of 10 mice immunized with gB1666 DNA generated detectable anti-gB IgG titers. Mean±SD, LLOQ=25.

Figure 12:

FIG. 12 depicts the structural model of engineered gB1666 (light gray, structure code: P-GB-002) is overlaid with the structural model of wild type HCMV gB (dark gray, structure code: P-GB-001). The new structure allows modeling of additional residues, 437-448 and 478-482 at the membrane distal end of the molecule and 770-779 in the transmembrane domain.

Figure 13:
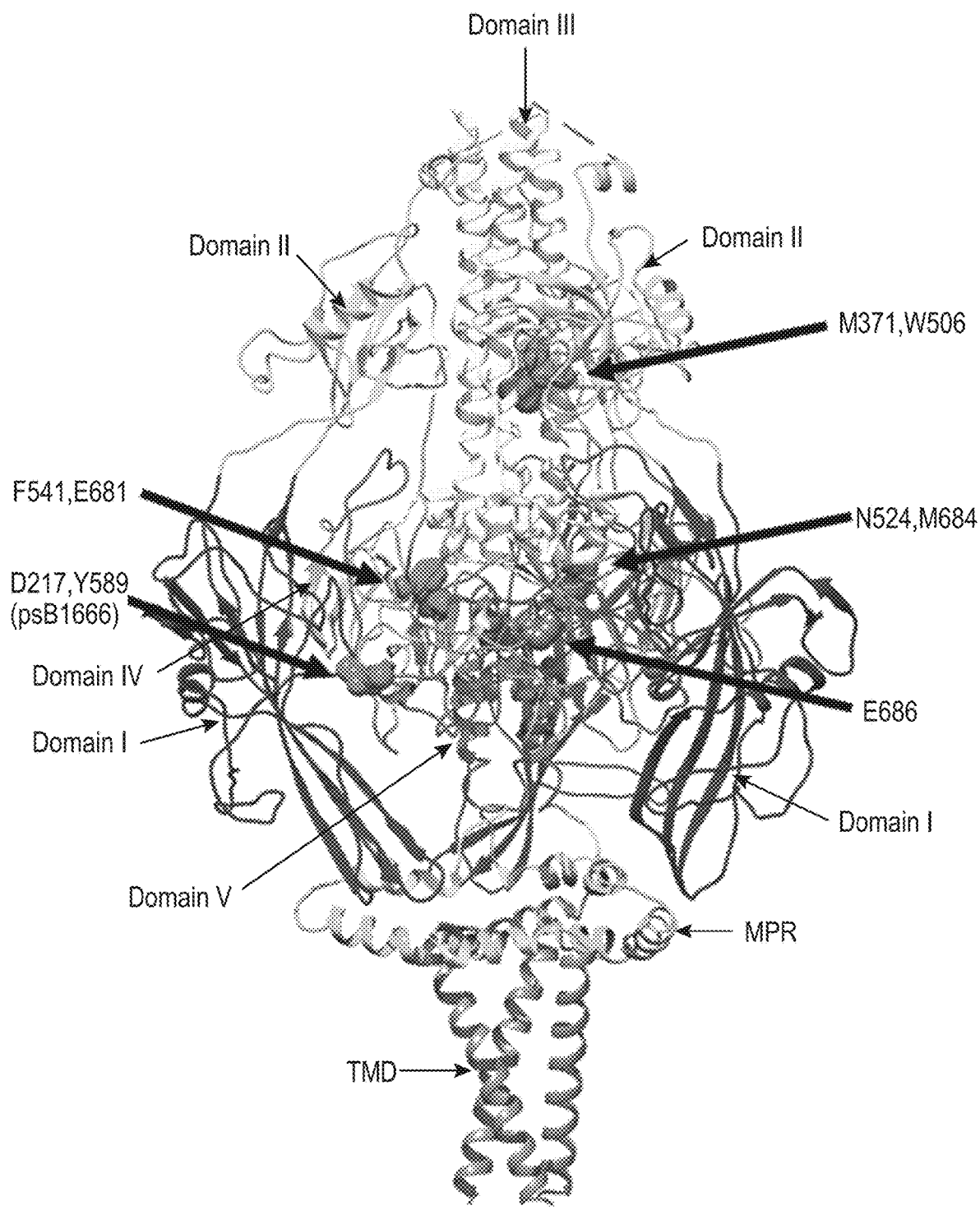

FIG. 13 depicts an example of the combinations of additional mutation combinations on the pSB1666 background that could further stabilize prefusion gB. Disulfide bond at M371, W506 could link domains II and III. Disulfide bonds at N524, M684 and F541, E681 could link domains IV and V. Mutations of negatively charged patches at E686 to hydrophobic residues could further stabilize gB in prefusion conformation.

Each domain is identified. Abbreviations: membrane proximal region (MPR), and transmembrane domain (TMD).

Figure 14:
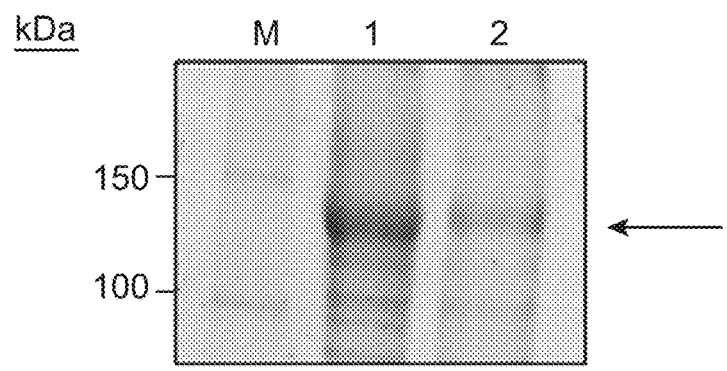

FIG. 14 depicts a SDS-PAGE documenting the expression and purification of recombinant gB2459 protein. The pSB2459 expression plasmid was transiently transfected into Expi293F cells. The cell pellets were harvested 68 hours after transfection, and the glycoprotein product gB2459 was purified in 25 mM HEPES pH 7.5, 250 mM NaCl, 0.02% n-Dodecyl β-D-maltoside (DDM), 0.002% cholesteryl hemi-succinate (CHS) through a series of processes of solubilization, affinity and size exclusion chromatography. This figure shows the purified protein analyzed by stain-free 4-20% SDS-PAGE under reducing conditions. The smearing of the protein band is consistent with gB2459 being heavily glycosylated. Lane M: protein marker; Lane 1: gB2457; and Lane 2: gB2459.

Figure 15:
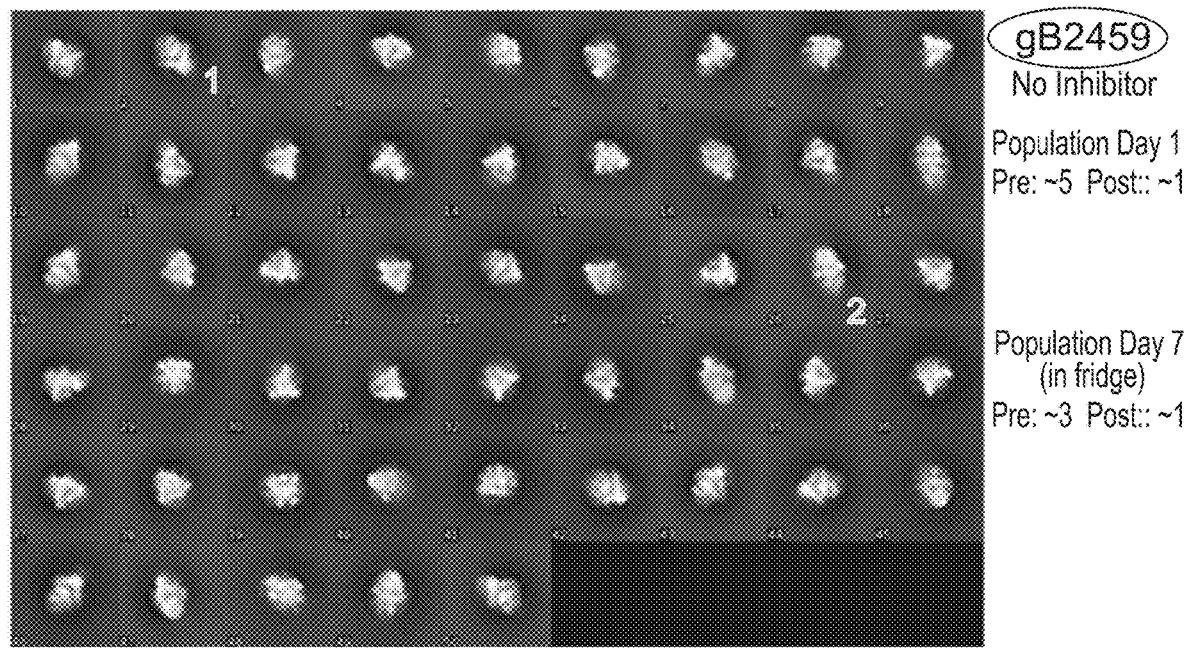

FIG. 15 depicts the construct pSB2459 which contains N524C and M684C mutations on the pSB1666 background. The protein product gB2459 was purified through affinity tags without the presence of any fusion inhibitors. There are prefusion classes observed in the 2D class averaged images (two classes with obvious prefusion features are indicated with the numbers 1 and 2). In addition, the prefusion gB2459 is stable over a period of a few days. Sample solution of gB2459 was stored at 4° C., aliquots of the sample were obtained at day 1 and day 7 to prepare the negative stained grids. An images dataset was collected and processed on these two grids. For each dataset, the particle populations in the prefusion and postfusion 2D classes were counted: the ratio between prefusion and postfusion conformation was 5:1 for the sample at day 1 and 3:1 at day 7.

Figure 16A:
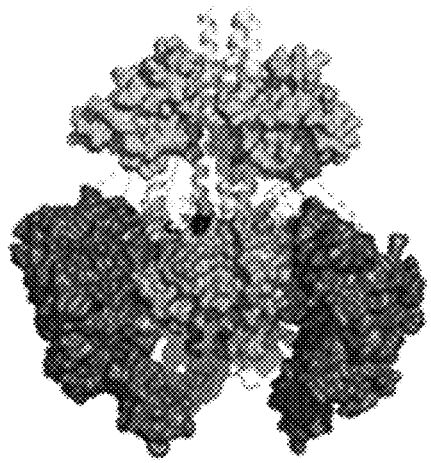
Figure 16B:
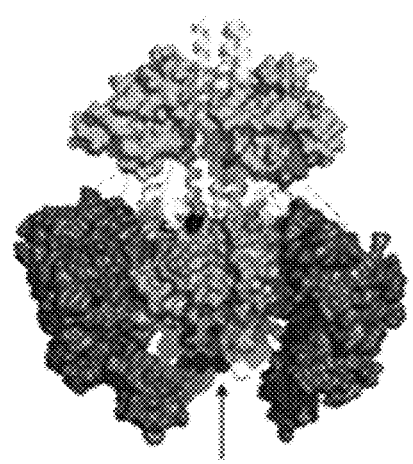
Figure 16C:
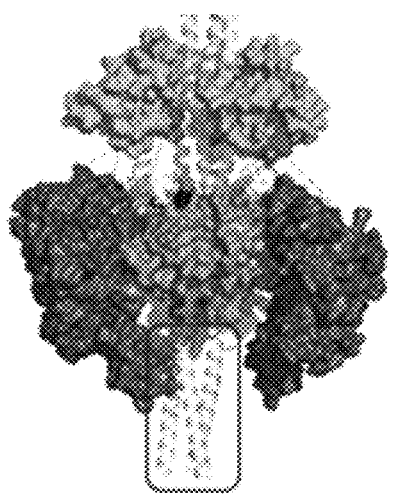
Figure 16D:
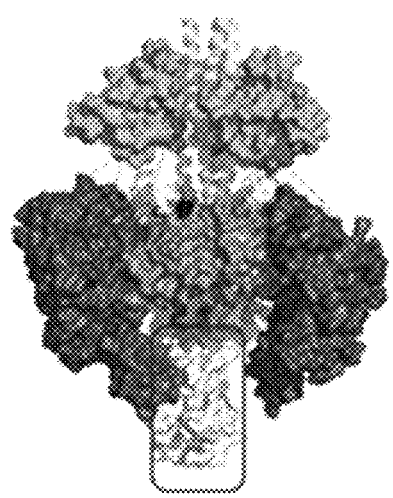

FIG. 16A-16D depict the design of soluble, detergent-free gB ectodomains. FIG. 16A shows gB ectodomain (1-707) with MPR, TM and CT regions removed. FIG. 16B shows gB ectodomain stabilized with additional cysteine mutations, e.g. D7030 and P7040, in Domain V. FIG. 16C shows gB ectodomain fused to a C-terminal GCN4 trimerization motif. FIG. 16D shows gB ectodomain fused to a C-terminal T4 fibritin foldon domain. Legend: Domain I (residues 134-344)—dark gray 3D volume structure; Domain II (residues 121-133 and 345-436)—light gray 3D volume structure; Domain III (residues 97-111, 475-539 and 640-648)—top center light gray vertical coils; Domain V (residues 649-707)—bottom internal dark gray coils (see arrow FIG. 16B); and rectangle—trimerization location.

Figure 17:
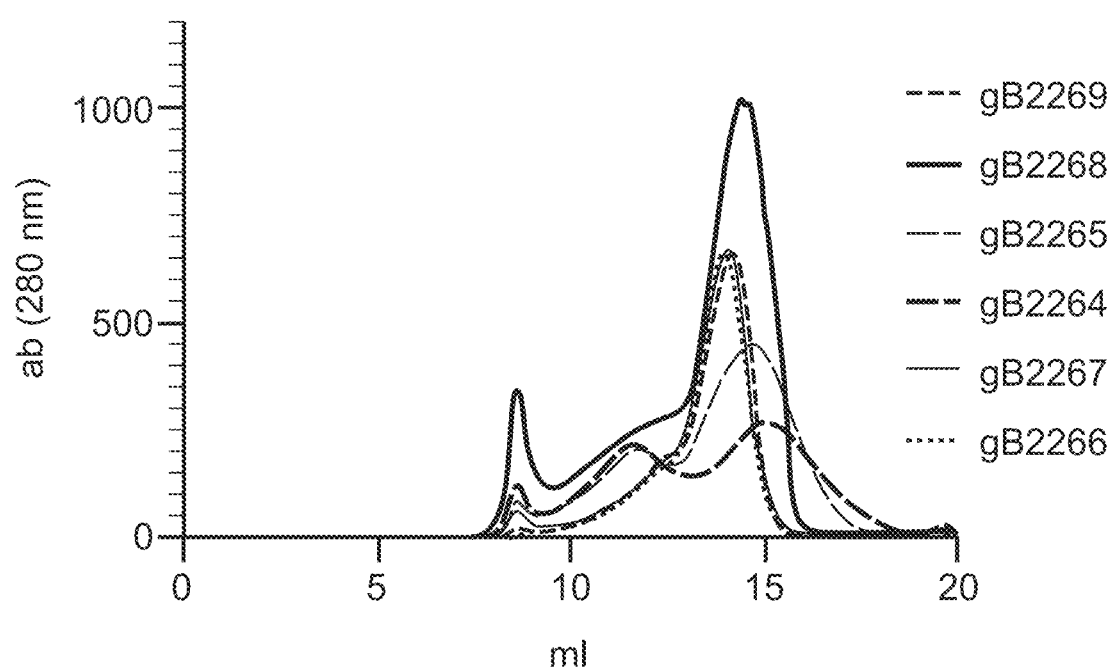

FIG. 17 depicts gel-filtration profiles of purified gB ectodomains, gB2264-gB2269, analyzed by Superose 6 Increase 10/300 in 20 mM HEPES pH 7.5, 250 mM NaCl.

Figure 18A:
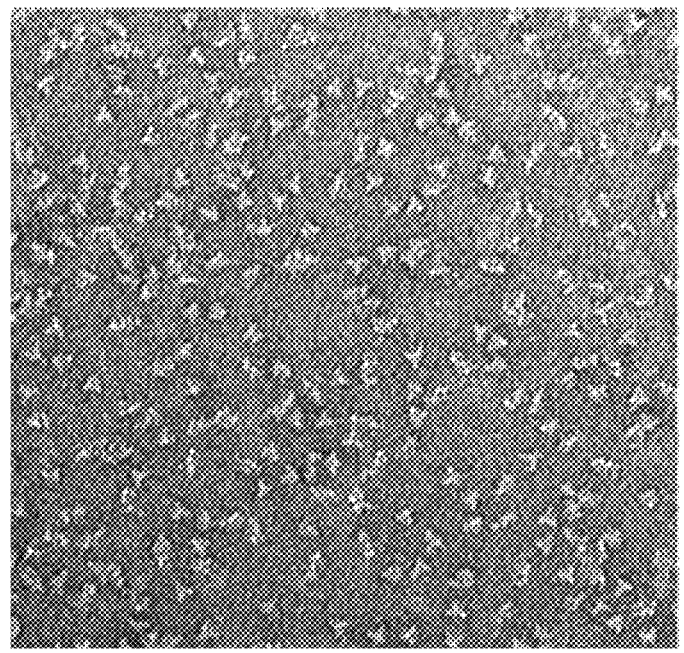
Figure 18B:
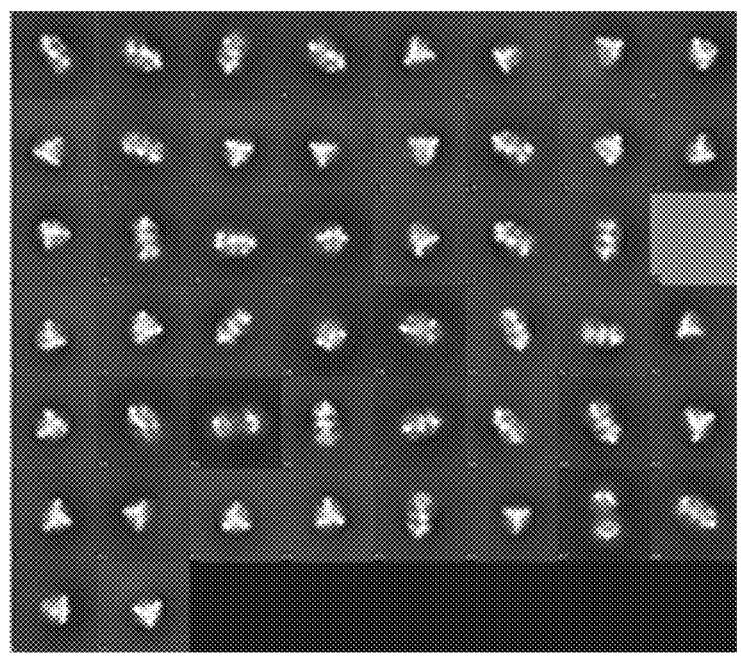

FIG. 18A-18B depict a Negative stain EM image (FIG. 18A) and representative 2D class averages (FIG. 18B) from negative stain EM of recombinant gB2555 without bound fusion inhibitor, which show monodispersed gB proteins are suitable to use as a framework to add more stabilizing mutations towards a prefusion form of gB in the absence of inhibitor and detergents.

Figure 19A:
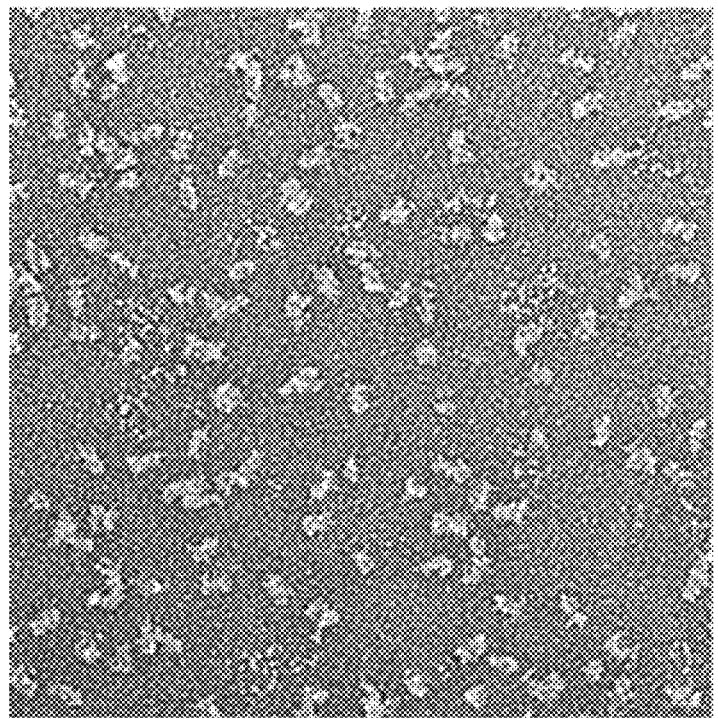
Figure 19B:
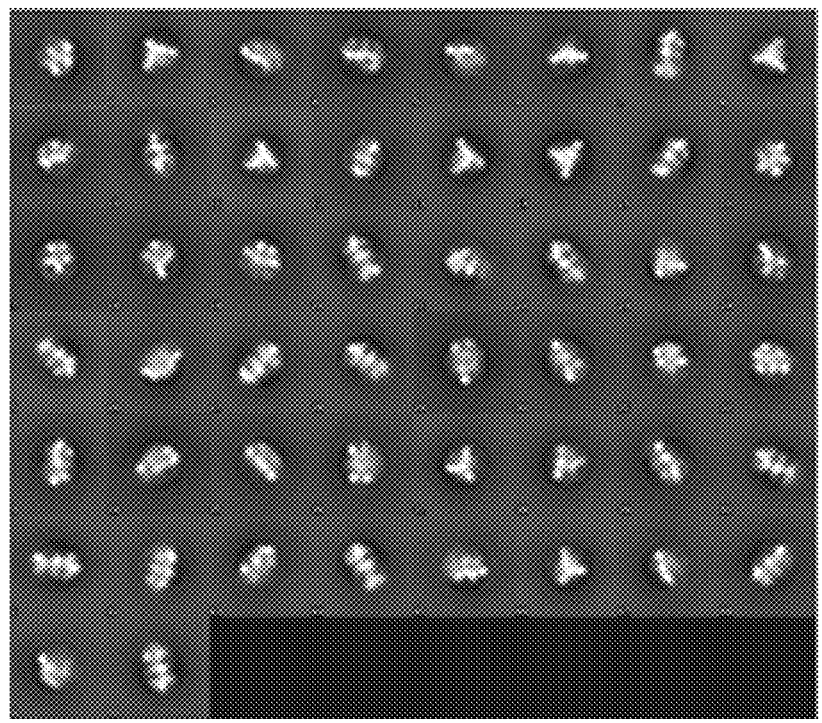

FIG. 19A-19B depict a Negative stain EM image (FIG. 19A) and representative 2D class averages (FIG. 19B) from negative stain EM of recombinant gB2556 without bound fusion inhibitor, which show monodispersed gB proteins are suitable to use as a framework to add more stabilizing mutations towards a prefusion form of gB in the absence of inhibitor and detergents.

Figure 20A:
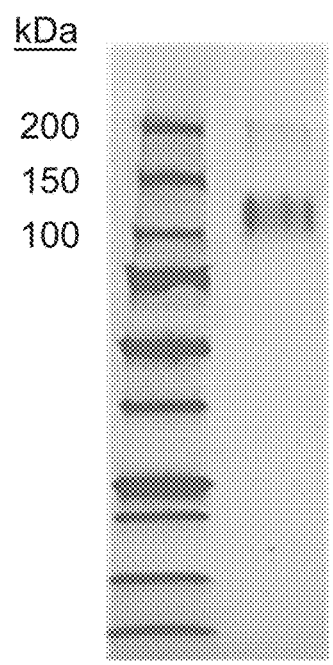
Figure 20B:
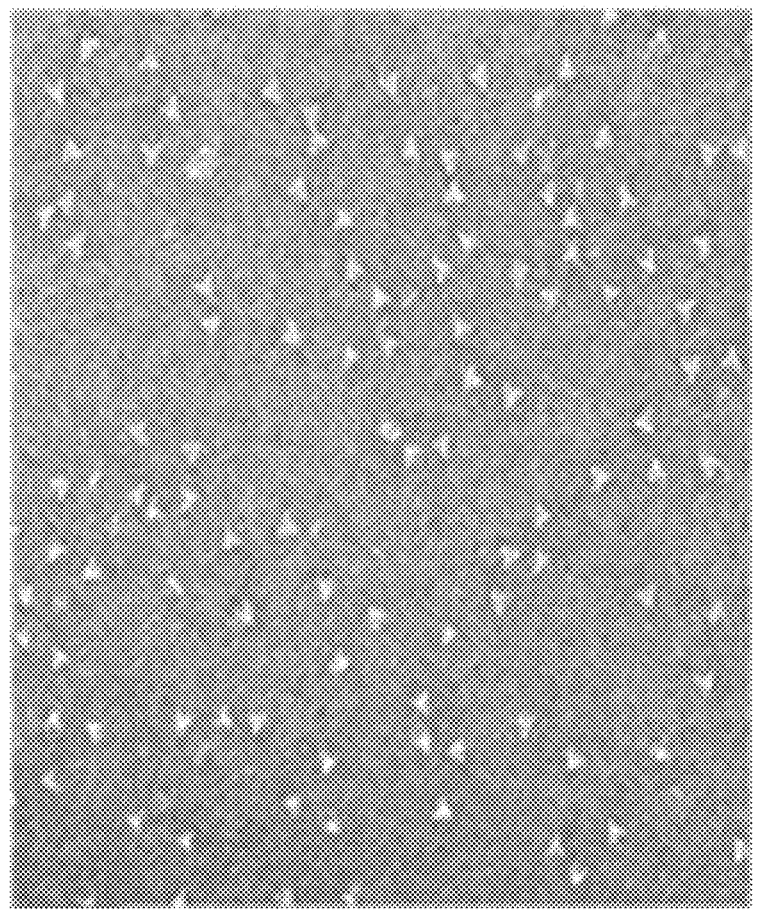

FIG. 20A-20B depict: the purified protein analyzed on 4-20% Mini-PROTEAN® TGX STAIN-FREE® Protein Gels (Biorad) in Tris/glycine/SDS buffer under reducing conditions (arrow shows protein on gel) (FIG. 20A); and the image of the negatively stained protein by electron microscopy (FIG. 20B).

Figure 21:
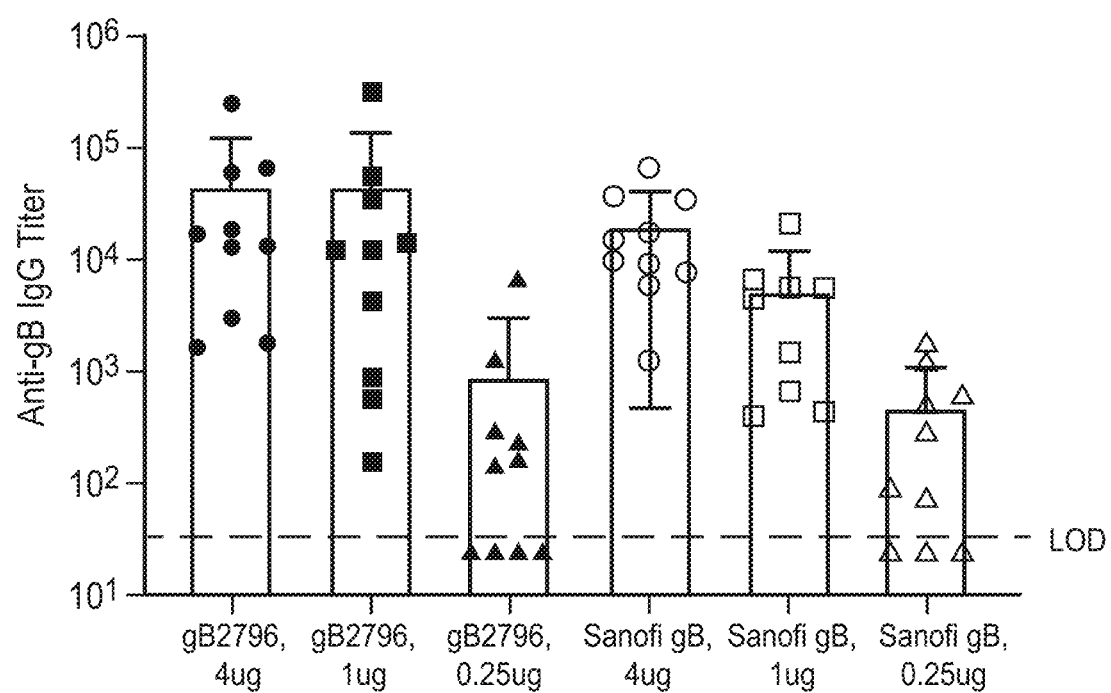

FIG. 21 depicts the dose-dependent IgG responses to gB in both gB2796 and Sanofi gB immunized mice.

Figure 22A:
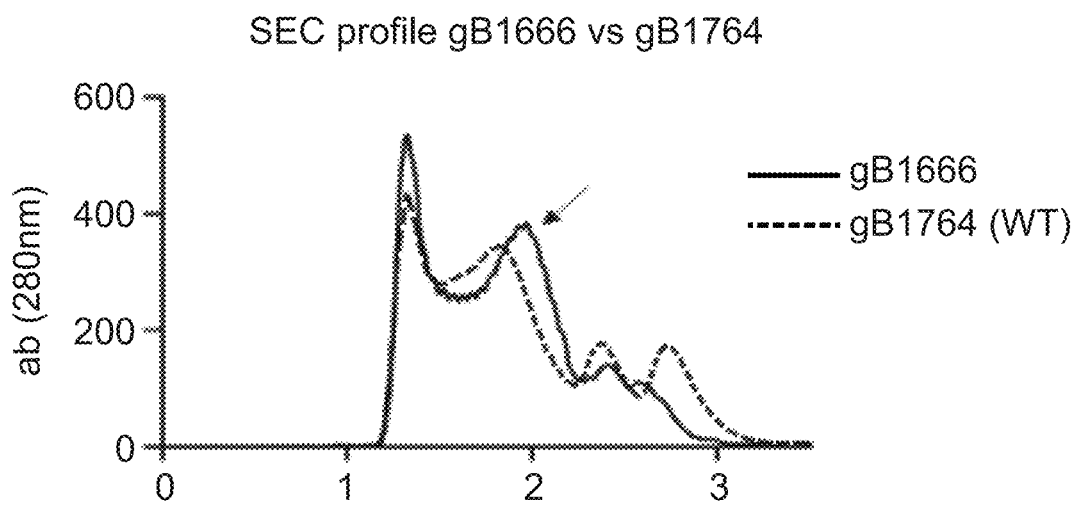
Figure 22B:
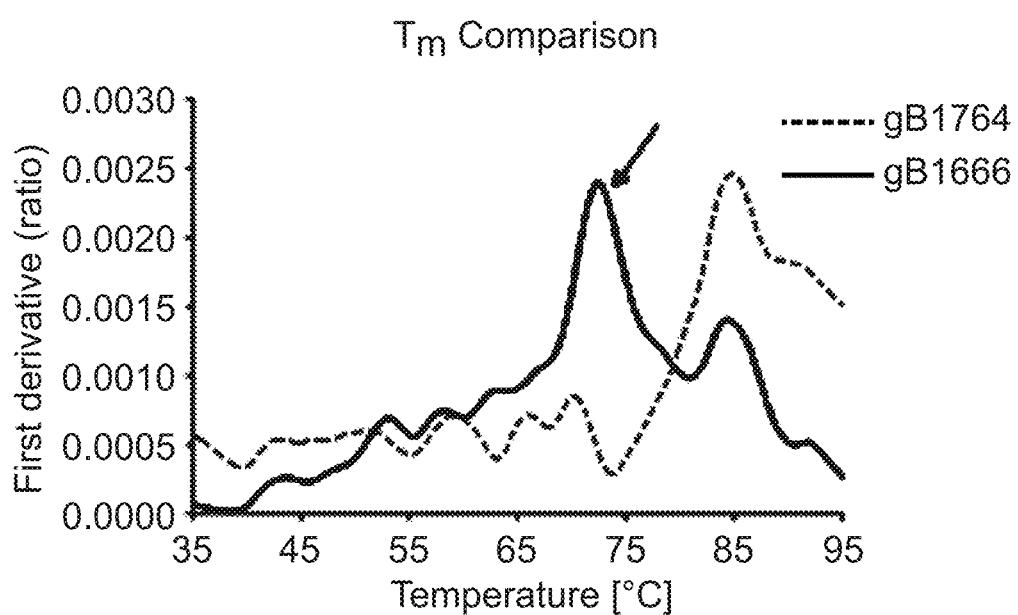

FIG. 22A-22B depict (i) FIG. 22A: the SEC profile comparison between gB1666 and gB1764 (the wild type CMVgB) (SEC is run on Superose6 increase 5/150 column in buffer 25 mM HEPES pH 7.5, 250 mM NaCl, 0.02% DDM, 0.002% CHS, 3 ug/ml WAY-174865); and (ii) FIG. 22B: thermal stability comparison between gB1666 and gB1764 (the assay is run on Tycho NT.6 with 20° C./min heating rate).

Figure 23A:
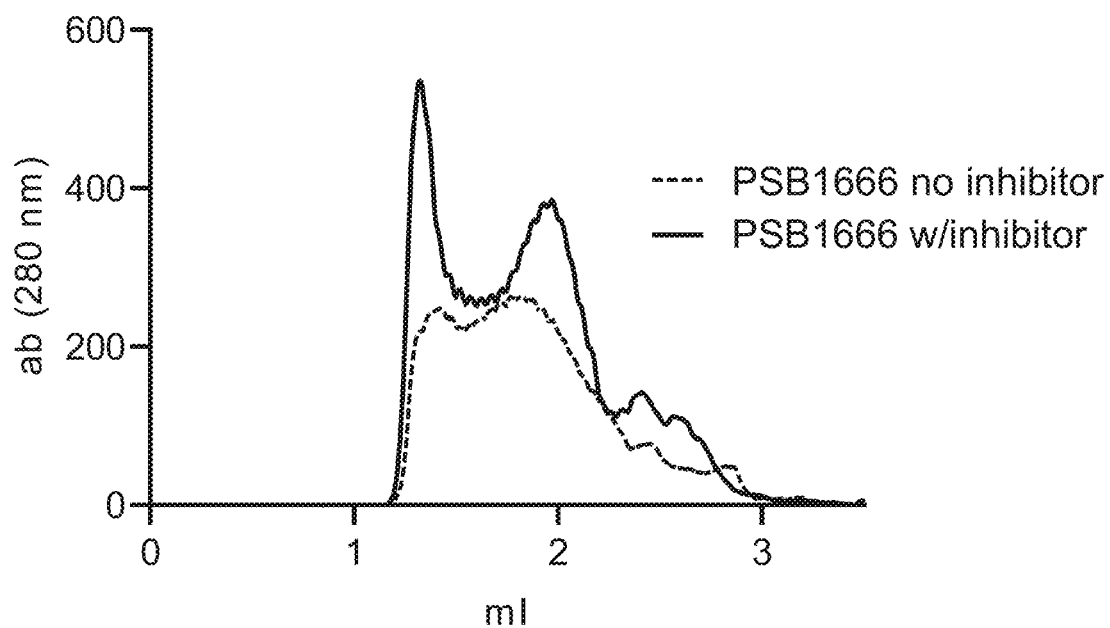
Figure 23B:
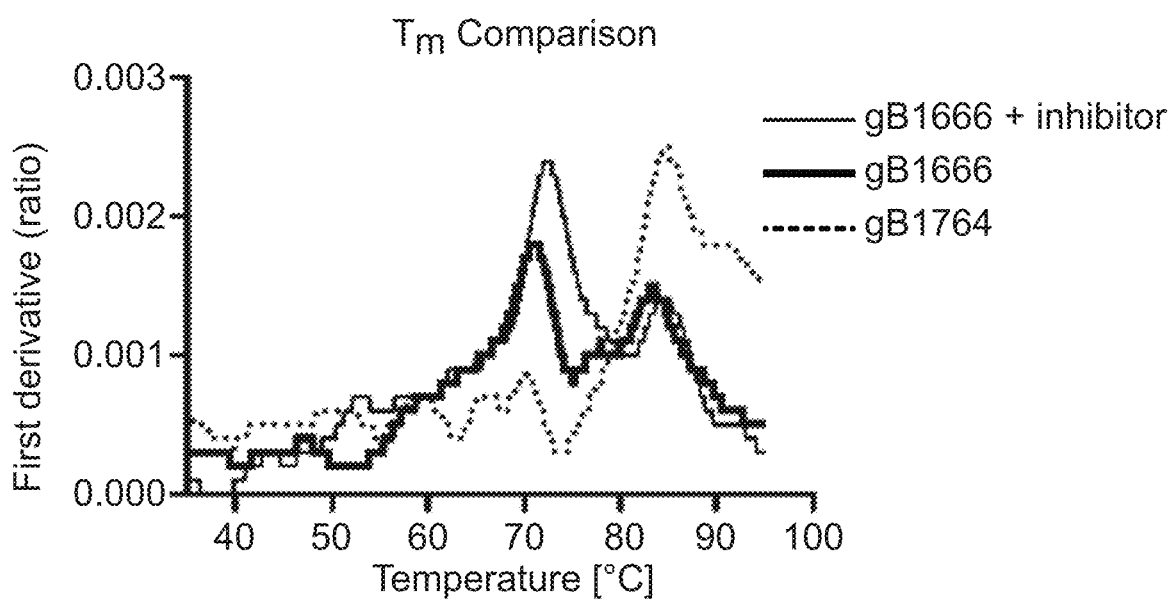

FIG. 23A-23B depict (i) FIG. 23A: SEC profile of gB1666 with or without the inhibitor WAY-174865 (SEC is run on Superose6 increase 5/150 column in buffer 25 mM HEPES pH 7.5, 250 mM NaCl, 0.02% DDM, 0.002% CHS, 3 ug/ml WAY-174865); and (ii) FIG. 23B: thermal stability comparison among gB1666, gB1666 with inhibitor and gB1764 (the assay is run on Tycho NT.6 with 20° C./min heating rate).

Figure 24A:
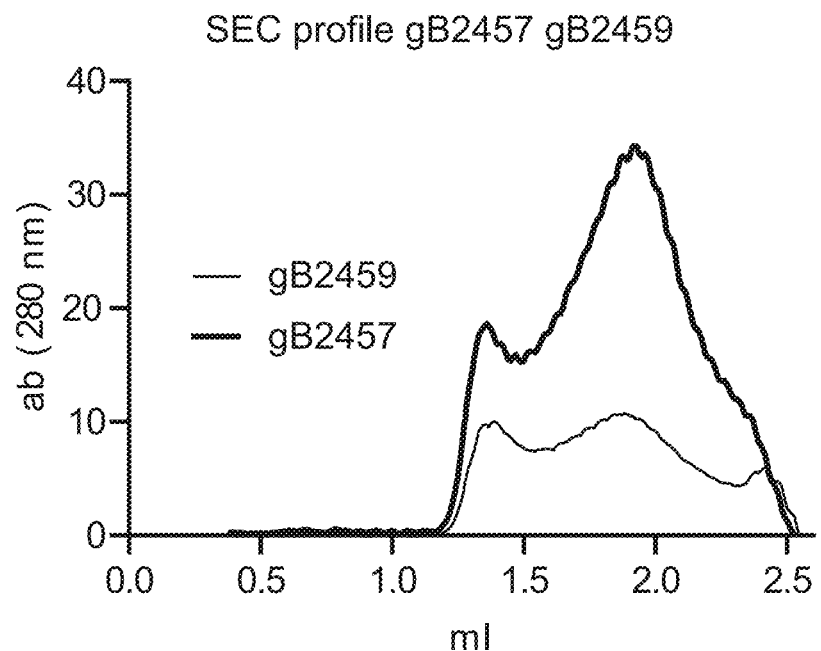
Figure 24B:
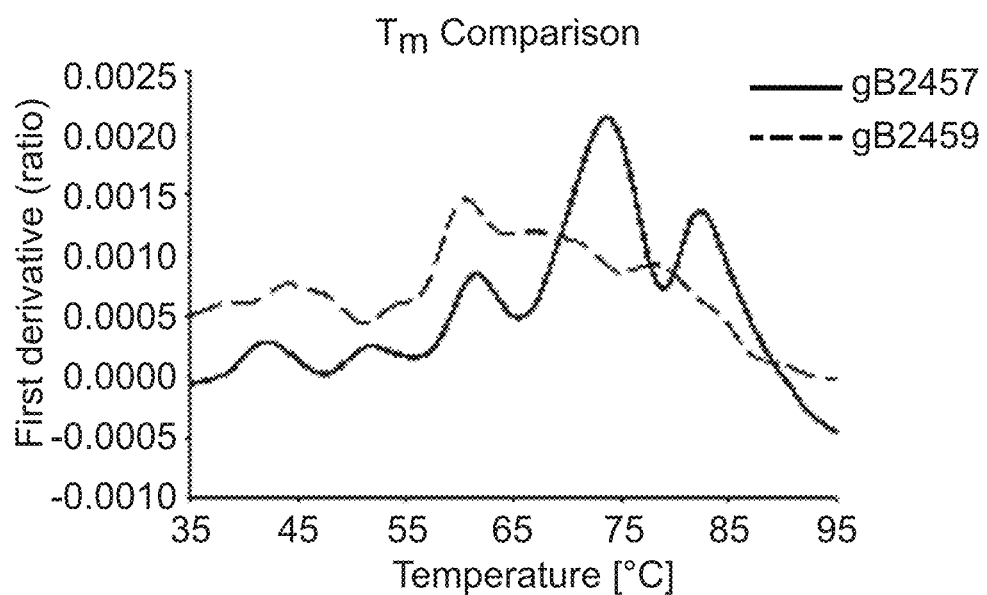

FIG. 24A-24B depict (i) FIG. 24A: SEC profile comparison of gB2457 and gB2459 (SEC is run on Superose6 increase 5/150 column in buffer 25 mM HEPES pH 7.5, 250 mM NaCl, 0.02% DDM, 0.002% CHS); and (ii) FIG. 24B: thermal stability comparison between gB2457 and gB2459 (the assay is run on Tycho NT.6 with 20° C./min heating rate).

Figure 25A:
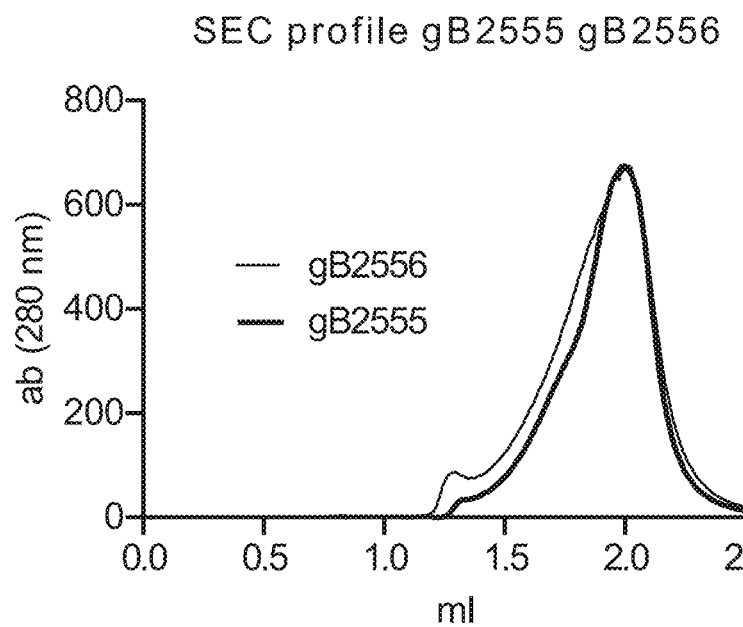
Figure 25B:
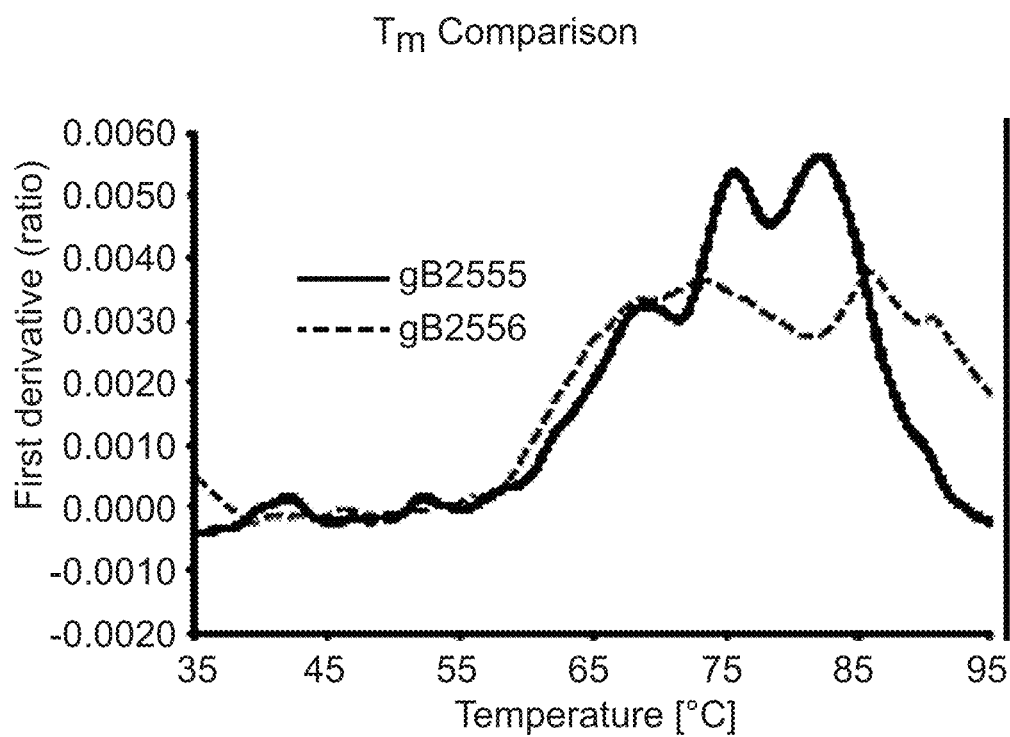
Figure 25C:
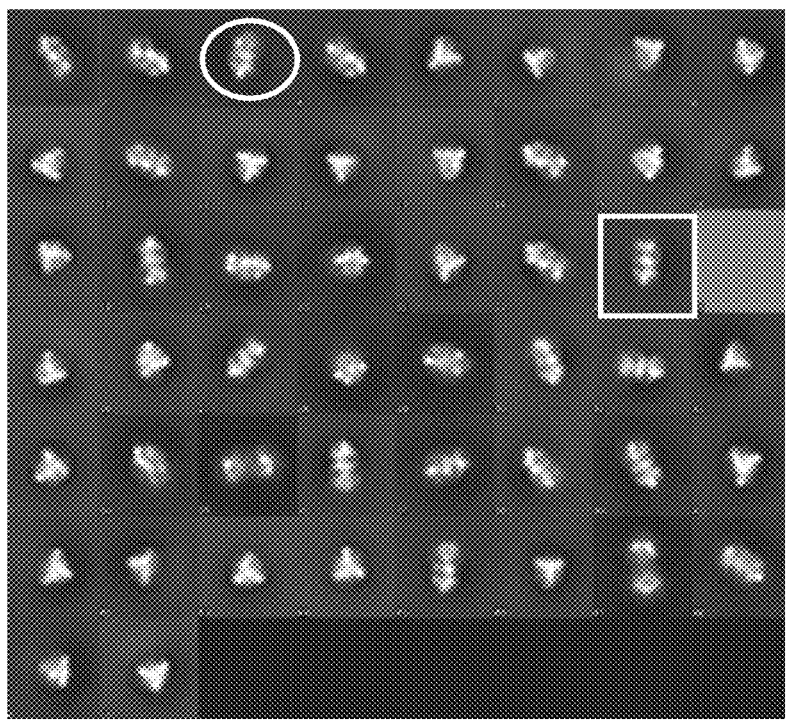
Figure 25D:
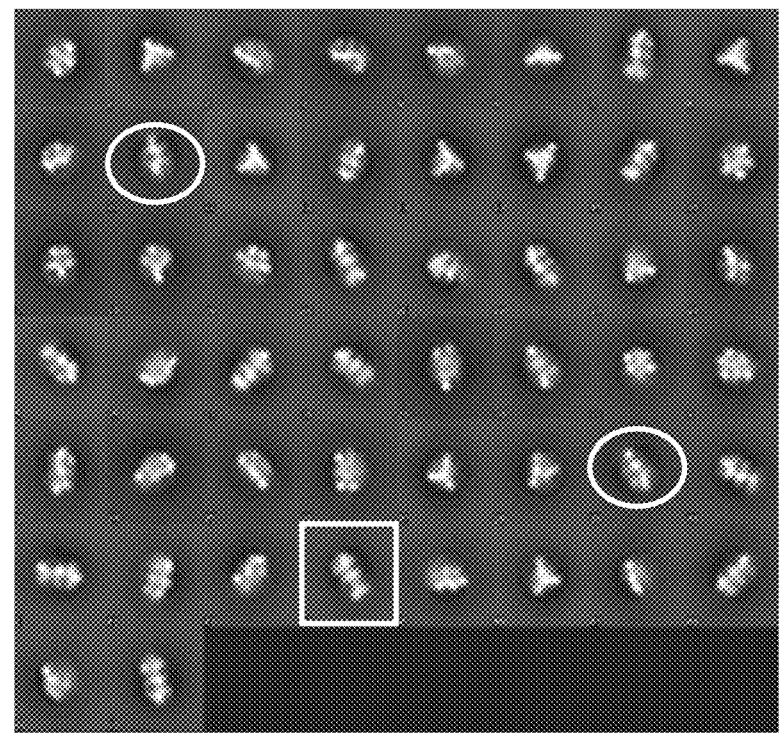

FIG. 25A-25D depict (i) FIG. 25A: SEC profile comparison of gB2555 and gB2556 (SEC is run on Superose6 increase 5/150 column in buffer 20 mM HEPES pH 7.5, 250 mM NaCl); (ii) FIG. 25B: thermal stability comparison between gB2555 and gB2556 (the assay is run on Tycho NT.6 with 20° C./min heating rate); (iii) FIG. 25C: 2D class averaged from negatively stained EM images of gB2555; and (iv) FIG. 25D: 2D class averaged from negatively stained EM images of gB2556. In FIGS. 25C and 25D, representative classes for prefusion gB (tapered shape) are indicated with a circle and postfusion gB are indicated with a square.

Figure 26A:
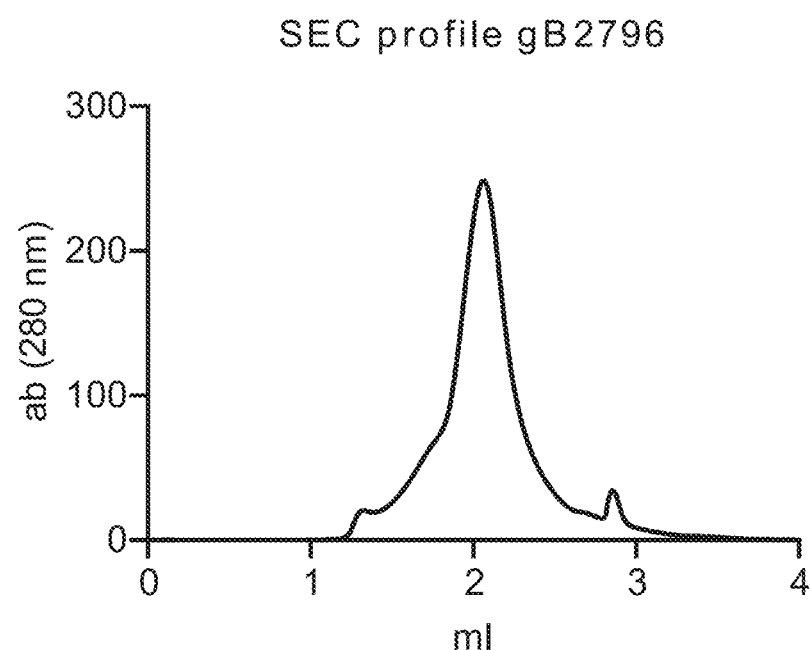
Figure 26B:
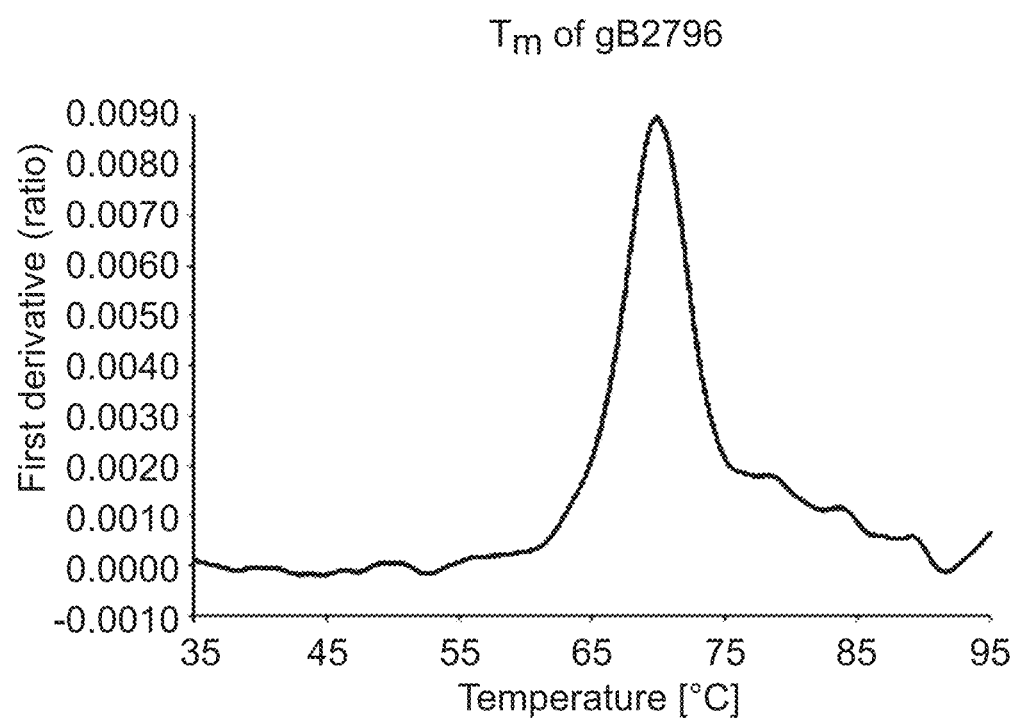

FIG. 26A-26B depict (i) FIG. 26A: SEC profile comparison of gB2796 (SEC is run on Superose6 increase 5/150 column in buffer 20 mM HEPES pH 7.5, 250 mM NaCl); and FIG. 26B: thermal stability of gB2796 (the assay is run on Tycho NT.6 with 20° C./min heating rate).

SEQUENCE IDENTIFIERS

SEQ ID NO: 1 sets forth an amino acid sequence derived from a native HCMV gB (strain Towne).

SEQ ID NO: 2 sets forth the amino acid sequence of SEQ ID NO: 1, wherein the following mutations are included: Q98C, G271C.

SEQ ID NO: 3 sets forth the amino acid sequence of SEQ ID NO: 1, wherein the following mutations are included: Q98C, I653C.

SEQ ID NO: 4 sets forth the amino acid sequence of SEQ ID NO: 1, wherein the following mutations are included: G99C, A267C.

SEQ ID NO: 5 sets forth the amino acid sequence of SEQ ID NO: 1, wherein the following mutations are included: T100C, A267C.

SEQ ID NO: 6 sets forth the amino acid sequence of SEQ ID NO: 1, wherein the following mutations are included: T100C, S269C.

SEQ ID NO: 7 sets forth the amino acid sequence of SEQ ID NO: 1, wherein the following mutations are included: T100C, L651C.

SEQ ID NO: 8 sets forth the amino acid sequence of SEQ ID NO: 1, wherein the following mutations are included: D217C, F584C.

SEQ ID NO: 9 sets forth the amino acid sequence of SEQ ID NO: 1, wherein the following mutations are included: Y218C, A585C.

SEQ ID NO: 10 sets forth the amino acid sequence of SEQ ID NO: 1, wherein the following mutations are included: S219C, D654C.

SEQ ID NO: 11 sets forth the amino acid sequence of SEQ ID NO: 1, wherein the following mutations are included: N220C, D652C.

SEQ ID NO: 12 sets forth the amino acid sequence of SEQ ID NO: 1, wherein the following mutations are included: T221C, D652C.

SEQ ID NO: 13 sets forth the amino acid sequence of SEQ ID NO: 1, wherein the following mutations are included: W240C, G718C.

SEQ ID NO: 14 sets forth the amino acid sequence of SEQ ID NO: 1, wherein the following mutations are included: Y242C, K710C.

SEQ ID NO: 15 sets forth the amino acid sequence of SEQ ID NO: 1, wherein the following mutations are included: Y242C, D714C.

SEQ ID NO: 16 sets forth the amino acid sequence of SEQ ID NO: 1, wherein the following mutations are included: S269C, I653C.

SEQ ID NO: 17 sets forth the amino acid sequence of SEQ ID NO: 1, wherein the following mutations are included: G271C, P614C.

SEQ ID NO: 18 sets forth the amino acid sequence of SEQ ID NO: 1, wherein the following mutations are included: S367C, L499C.

SEQ ID NO: 19 sets forth the amino acid sequence of SEQ ID NO: 1, wherein the following mutations are included: T372C, W506C.

SEQ ID NO: 20 sets forth the amino acid sequence of SEQ ID NO: 1, wherein the following mutations are included: F541C, Q669C.

SEQ ID NO: 21 sets forth the amino acid sequence of SEQ ID NO: 1, wherein the following mutations are included: L548C, A650C.

SEQ ID NO: 22 sets forth the amino acid sequence of SEQ ID NO: 1, wherein the following mutations are included: A549C, I653C.

SEQ ID NO: 23 sets forth the amino acid sequence of SEQ ID NO: 1, wherein the following mutations are included: S550C, D652C.

SEQ ID NO: 24 sets forth the amino acid sequence of SEQ ID NO: 1, wherein the following mutations are included: G604C, F661C.

SEQ ID NO: 25 sets forth the amino acid sequence of SEQ ID NO: 1, wherein the following mutations are included: N605C, E665C.

SEQ ID NO: 26 sets forth the amino acid sequence of SEQ ID NO: 1, wherein the following mutations are included: R607C, S675C.

SEQ ID NO: 27 sets forth the amino acid sequence of SEQ ID NO: 1, wherein the following mutations are included: T608C, D679C.

SEQ ID NO: 28 sets forth the amino acid sequence of SEQ ID NO: 1, wherein the following mutations are included: E609C, F678C.

SEQ ID NO: 29 sets forth the amino acid sequence of SEQ ID NO: 1, wherein the following mutations are included: R673C, S674C.

SEQ ID NO: 30 sets forth the amino acid sequence of SEQ ID NO: 1, wherein the following mutations are included: N676C, V677C.

SEQ ID NO: 31 sets forth the amino acid sequence of SEQ ID NO: 1, wherein the following mutations are included: L680C, E681C.

SEQ ID NO: 32 sets forth the amino acid sequence of SEQ ID NO: 1, wherein the following mutations are included: I683C, M684C.

SEQ ID NO: 33 sets forth the amino acid sequence of SEQ ID NO: 1, wherein the following mutations are included: F687C, N688C.

SEQ ID NO: 34 sets forth the amino acid sequence of SEQ ID NO: 1, wherein the following mutations are included: Y690C, K691C.

SEQ ID NO: 35 sets forth the amino acid sequence of SEQ ID NO: 1, wherein the following mutations are included: K695C, K724C.

SEQ ID NO: 36 sets forth the amino acid sequence of SEQ ID NO: 1, wherein the following mutations are included: T746C, F747C.

SEQ ID NO: 37 sets forth the amino acid sequence of SEQ ID NO: 1, wherein the following mutations are included: K749C, N750C.

SEQ ID NO: 38 sets forth the amino acid sequence of SEQ ID NO: 1, wherein the following mutation is included: K670L.

SEQ ID NO: 39 sets forth the amino acid sequence of SEQ ID NO: 1, wherein the following mutation is included: K670F.

SEQ ID NO: 40 sets forth the amino acid sequence of SEQ ID NO: 1, wherein the following mutation is included: R673L.

SEQ ID NO: 41 sets forth the amino acid sequence of SEQ ID NO: 1, wherein the following mutation is included: R673F.

SEQ ID NO: 42 sets forth the amino acid sequence of SEQ ID NO: 1, wherein the following mutation is included: K691L.

SEQ ID NO: 43 sets forth the amino acid sequence of SEQ ID NO: 1, wherein the following mutation is included: K691F.

SEQ ID NO: 44 sets forth the amino acid sequence for a native HCMV gB (AD169; PDB: 5CXF) that folds into a postfusion conformation when expressed.

SEQ ID NO: 45 sets forth the amino acid sequence for an HCMV gB variant (gB705) that folds into a postfusion conformation when expressed.

SEQ ID NO: 46 sets forth the amino acid sequence for a native HCMV gB (Merlin strain) that folds into a postfusion conformation when expressed.

SEQ ID NO: 47 sets forth the amino acid of SEQ ID NO: 1, wherein the following mutations are included: M96C and D660C.

SEQ ID NO: 48 sets forth the amino acid of SEQ ID NO: 1, wherein the following mutations are included: Q98C and N658C.

SEQ ID NO: 49 sets forth the amino acid of SEQ ID NO: 1, wherein the following mutations are included: T100C and R258C.

SEQ ID NO: 50 sets forth the amino acid of SEQ ID NO: 1, wherein the following mutations are included: T100C and L656C.

SEQ ID NO: 51 sets forth the amino acid of SEQ ID NO: 1, wherein the following mutations are included: T100C and N658C.

SEQ ID NO: 52 sets forth the amino acid of SEQ ID NO: 1, wherein the following mutations are included: I117C and T406C.

SEQ ID NO: 53 sets forth the amino acid of SEQ ID NO: 1, wherein the following mutations are included: I117C and S407C.

SEQ ID NO: 54 sets forth the amino acid of SEQ ID NO: 1, wherein the following mutations are included: Y153C and L712C.

SEQ ID NO: 55 sets forth the amino acid of SEQ ID NO: 1, wherein the following mutations are included: L162C and M716C.

SEQ ID NO: 56 sets forth the amino acid of SEQ ID NO: 1, wherein the following mutations are included: D217C and S587C.

SEQ ID NO: 57 sets forth the amino acid of SEQ ID NO: 1, wherein the following mutations are included: D217C and Y589C.

SEQ ID NO: 58 sets forth the amino acid of SEQ ID NO: 1, wherein the following mutations are included: S219C and F584C.

SEQ ID NO: 59 sets forth the amino acid of SEQ ID NO: 1, wherein the following mutations are included: S219C and A585C.

SEQ ID NO: 60 sets forth the amino acid of SEQ ID NO: 1, wherein the following mutations are included: S219C and N586C.

SEQ ID NO: 61 sets forth the amino acid of SEQ ID NO: 1, wherein the following mutations are included: N220C and T659C.

SEQ ID NO: 62 sets forth the amino acid of SEQ ID NO: 1, wherein the following mutations are included: S223C and T659C.

SEQ ID NO: 63 sets forth the amino acid of SEQ ID NO: 1, wherein the following mutations are included: W240C and A732A.

SEQ ID NO: 64 sets forth the amino acid of SEQ ID NO: 1, wherein the following mutations are included: W240C and G735C.

SEQ ID NO: 65 sets forth the amino acid of SEQ ID NO: 1, wherein the following mutations are included: Y242C and V728C.

SEQ ID NO: 66 sets forth the amino acid of SEQ ID NO: 1, wherein the following mutations are included: Y242C and G731C.

SEQ ID NO: 67 sets forth the amino acid of SEQ ID NO: 1, wherein the following mutations are included: R258C and L656C.

SEQ ID NO: 68 sets forth the amino acid of SEQ ID NO: 1, wherein the following mutations are included: S269C and L656C.

SEQ ID NO: 69 sets forth the amino acid of SEQ ID NO: 1, wherein the following mutations are included: S269C and N658C.

SEQ ID NO: 70 sets forth the amino acid of SEQ ID NO: 1, wherein the following mutations are included: D272C and P614C.

SEQ ID NO: 71 sets forth the amino acid of SEQ ID NO: 1, wherein the following mutations are included: V273C and V629C.

SEQ ID NO: 72 sets forth the amino acid of SEQ ID NO: 1, wherein the following mutations are included: W349C and A650C.

SEQ ID NO: 73 sets forth the amino acid of SEQ ID NO: 1, wherein the following mutations are included: S367C and A500C.

SEQ ID NO: 74 sets forth the amino acid of SEQ ID NO: 1, wherein the following mutations are included: S367C and A503C.

SEQ ID NO: 75 sets forth the amino acid of SEQ ID NO: 1, wherein the following mutations are included: K370C and Q501C.

SEQ ID NO: 76 sets forth the amino acid of SEQ ID NO: 1, wherein the following mutations are included: K522C and I683C.

SEQ ID NO: 77 sets forth the amino acid of SEQ ID NO: 1, wherein the following mutations are included: I523C and I683C.

SEQ ID NO: 78 sets forth the amino acid of SEQ ID NO: 1, wherein the following mutations are included: I523C and M684C.

SEQ ID NO: 79 sets forth the amino acid of SEQ ID NO: 1, wherein the following mutations are included: N524C and M684C.

SEQ ID NO: 80 sets forth the amino acid of SEQ ID NO: 1, wherein the following mutations are included: P525C and E681C.

SEQ ID NO: 81 sets forth the amino acid of SEQ ID NO: 1, wherein the following mutations are included: R540C and L680C.

SEQ ID NO: 82 sets forth the amino acid of SEQ ID NO: 1, wherein the following mutations are included: F541C and L680C.

SEQ ID NO: 83 sets forth the amino acid of SEQ ID NO: 1, wherein the following mutations are included: L548C and P655C.

SEQ ID NO: 84 sets forth the amino acid of SEQ ID NO: 1, wherein the following mutations are included: A549C and N658C.

SEQ ID NO: 85 sets forth the amino acid of SEQ ID NO: 1, wherein the following mutations are included: S550C and P655C.

SEQ ID NO: 86 sets forth the amino acid of SEQ ID NO: 1, wherein the following mutations are included: S550C and E657C.

SEQ ID NO: 87 sets forth the amino acid of SEQ ID NO: 1, wherein the following mutations are included: Q591C and S668C.

SEQ ID NO: 88 sets forth the amino acid of SEQ ID NO: 1, wherein the following mutations are included: L603C and Y667C.

SEQ ID NO: 89 sets forth the amino acid of SEQ ID NO: 1, wherein the following mutations are included: G604C and L672C.

SEQ ID NO: 90 sets forth the amino acid of SEQ ID NO: 1, wherein the following mutations are included: R607C and N688C.

SEQ ID NO: 91 sets forth the amino acid of SEQ ID NO: 1, wherein the following mutations are included: T608C and Q692C.

SEQ ID NO: 92 sets forth the amino acid of SEQ ID NO: 1, wherein the following mutations are included: E609C and K691C.

SEQ ID NO: 93 sets forth the amino acid of SEQ ID NO: 1, wherein the following mutations are included: E610C and S674C.

SEQ ID NO: 94 sets forth the amino acid of SEQ ID NO: 1, wherein the following mutations are included: E610C and S675C.

SEQ ID NO: 95 sets forth the amino acid of SEQ ID NO: 1, wherein the following mutations are included: Q612C and V663C.

SEQ ID NO: 96 sets forth the amino acid of SEQ ID NO: 1, wherein the following mutations are included: V737C and F755C.

SEQ ID NO: 97 sets forth the amino acid of SEQ ID NO: 1, wherein the following mutations are included: V741C and A754C.

SEQ ID NO: 98 sets forth the amino acid of SEQ ID NO: 1, wherein the following mutations are included: V741C and F755C.

SEQ ID NO: 99 sets forth the amino acid of SEQ ID NO: 1, wherein the following mutation is included: D679S.

SEQ ID NO: 100 sets forth the amino acid of SEQ ID NO: 1, wherein the following mutation is included: D679N.

SEQ ID NO: 101 sets forth the amino acid of SEQ ID NO: 1, wherein the following mutation is included: E682S.

SEQ ID NO: 102 sets forth the amino acid of SEQ ID NO: 1, wherein the following mutation is included: E682Q.

SEQ ID NO: 103 sets forth the amino acid of SEQ ID NO: 1, wherein the following mutation is included: E686S.

SEQ ID NO: 104 sets forth the amino acid of SEQ ID NO: 1, wherein the following mutation is included: E686Q.

SEQ ID NO: 105 sets forth the amino acid of SEQ ID NO: 1, wherein the following mutation is included: N118P.

SEQ ID NO: 106 sets forth the amino acid of SEQ ID NO: 1, wherein the following mutation is included: D646P.

SEQ ID NO: 107 sets forth the amino acid sequence for >5CXF:A|PDBID|CHAIN|SEQUENCE, from FIG. 8.

SEQ ID NO: 108 sets forth the amino acid sequence for >5CXF:B|PDBID|CHAIN|SEQUENCE, from FIG. 8.

SEQ ID NO: 109 sets forth the amino acid sequence for >5CXF:C|PDBID|CHAIN|SEQUENCE, from FIG. 8.

SEQ ID NO: 110 sets forth the amino acid sequence for a gB polypeptide from HAN13 gi|2423456141gb|GQ221973.1|:81988-84705 Human herpesvirus 5 strain HAN13, complete genome reverse complement, referenced in the description for FIG. 9.

SEQ ID NOs: 111 sets forth the amino acid sequence for a gB polypeptide from VR1814 gi|012703557591gb|GU179289.1|:81925-84642 Human herpesvirus 5 strain VR1814, complete genome reverse complement, referenced in the description for FIG. 9.

SEQ ID NOs: 112-140 sets forth the amino acid sequence for a gB polypeptide from various CMV gB strains described in FIG. 9.

SEQ ID NO: 141-SEQ ID NO: 210 set forth a polynucleotide sequence encoding a polypeptide derived from HCMV, such as for example, gH, gL, UL128, UL130, UL131, gB or pp65.

SEQ ID NO: 211-SEQ ID NO: 223 set forth an amino acid sequence for a polypeptide derived from HCMV, such as for example, gH, gL, UL128, UL130, UL131, gB or pp65. SEQ ID NO: 224 sets forth an amino acid sequence for a polypolypeptide derived from HCMV.

SEQ ID NO: 225-SEQ ID NO: 254 set forth a polynucleotide sequence encoding a polypolypeptide derived from HCMV.

SEQ ID NO: 255 sets forth the amino acid sequence of CMV gB1666, residues V23 to V907 of SEQ ID NO: 1 (Towne) having the following mutations: D217C, Y589C, and I675S. Does not include the signal sequence (residues M1-A22 of SEQ ID NO: 1).

SEQ ID NO: 256 sets forth the nucleic acid sequence of CMV gB1666 encoding residues V23 to V907 of SEQ ID NO: 1 (Towne) having the following mutations: D217C, Y589C, and I675S. Does not include nucleotides encoding the signal sequence (residues M1-A22 of SEQ ID NO: 1).

SEQ ID NO: 257 sets forth the amino acid sequence of CMV gB2457 (Prefusion, Full length), residues V23 to V907 of SEQ ID NO: 1 (Towne) having the following mutations: D217C, M371C, W506C, Y589C, and I675S. Does not include the signal sequence (residues M1-A22 of SEQ ID NO: 1).

SEQ ID NO: 258 sets forth the nucleic acid sequence of CMV gB2457 (Prefusion, Full length) encoding residues V23 to V907 of SEQ ID NO: 1 (Towne) having the following mutations: D217C, M371C, W506C, Y589C, and I675S. Does not include nucleotides encoding the signal sequence (residues M1-A22 of SEQ ID NO: 1).

SEQ ID NO: 259 sets forth the amino acid sequence of CMV gB2459 (Prefusion, Full length), residues V23 to V907 of SEQ ID NO: 1 (Towne) having the following mutations: D217C, N524C, Y589C, M684C, and I675S. Does not include the signal sequence (residues M1-A22 of SEQ ID NO: 1).

SEQ ID NO: 260 sets forth the nucleic acid sequence of CMV gB2459 (Prefusion, Full length) encoding residues V23 to V907 of SEQ ID NO: 1 (Towne) having the following mutations: D217C, N524C, Y589C, M684C, and I675S. Does not include nucleotides encoding the signal sequence (residues M1-A22 of SEQ ID NO: 1).

SEQ ID NO: 261 sets forth the amino acid sequence of CMV gB2555 (Prefusion, including trimerization domain (GCN4 CC tri2)), residues V23 to V702 of SEQ ID NO: 1 (Towne) having the following mutations: YIH to GHR (155-157), D217C, W240A, M371C, C246S, W506C, Y589C, and I675S. Does not include the signal sequence (residues M1-A22 of SEQ ID NO: 1).

SEQ ID NO: 262 sets forth the nucleic acid sequence of CMV gB2555 (Prefusion, including trimerization domain (GCN4 CC tri2)) encoding residues V23 to V702 of SEQ ID NO: 1 (Towne) having the following mutations: YIH to GHR (155-157), D217C, W240A, M371C, C246S, W506C, Y589C, and I675S. Does not include nucleotides encoding the signal sequence (residues M1-A22 of SEQ ID NO: 1).

SEQ ID NO: 263 sets forth the amino acid sequence of CMV gB2556 (Prefusion, including trimerization domain (GCN4 CC tri2)), residues V23 to V702 of SEQ ID NO: 1 (Towne) having the following mutations: YIH to GHR (155-157), D217C, W240A, C246S, N524C, Y589C, I675S, and M684C. Does not include the signal sequence (residues M1-A22 of SEQ ID NO: 1).

SEQ ID NO: 264 sets forth the nucleic acid sequence of CMV gB2556 (Prefusion, including trimerization domain (GCN4 CC tri2)) encoding residues V23 to V702 of SEQ ID NO: 1 (Towne) having the following mutations: YIH to GHR (155-157), D217C, W240A, C246S, N524C, Y589C, I675S, and M684C. Does not include nucleotides encoding the signal sequence (residues M1-A22 of SEQ ID NO: 1).

SEQ ID NO: 265 sets forth the amino acid sequence of CMV gB2796 (Prefusion, ectodomain), residues V23 to D646 of SEQ ID NO:1 (Towne) having the following mutations: YIH to GHR (155-157), D217C, W240A, C246S, M371C, W506C, and Y589C. Does not include the signal sequence (residues M1-A22 of SEQ ID NO: 1).

SEQ ID NO: 266 sets forth the nucleic acid sequence of CMV gB2796 (Prefusion, ectodomain) encoding amino acids V23 to D646 of SEQ ID NO:1 (Towne) having the following amino acid mutations: YIH to GHR (155-157), D217C, W240A, C246S, M371C, W506C, and Y589C. Does not include the nucleotides encoding the signal sequence (residues M1-A22 of SEQ ID NO: 1).

SEQ ID NO: 267 sets for the CMV gB ectodomain, V23 to P707 of SEQ ID NO:1 (Towne strain).

SEQ ID NO: 268 sets forth the amino acid sequence of the signal sequence of wt HCMV gB (Towne).

SEQ ID NO: 269 sets forth the amino acid sequence of GCN4 CC tri2 trimerization domain (see Table 9).

SEQ ID NO: 270 sets forth the nucleic acid sequence encoding the GCN4 CC tri2 trimerization domain.

SEQ ID NO: 271 sets forth the amino acid sequence of T4 fibritin foldon domain (see Table 9).

SEQ ID NO: 272-273 sets forth the amino acid sequences of various GCN4 trimerization domains.

SEQ ID NO: 274 sets forth the amino acid sequences of C-terminal fusion sequence described in Table 9.

DETAILED DESCRIPTION

As described herein, the inventors elucidated a three-dimensional structure of a HCMV glycoprotein B (gB) polypeptide in a conformation that differs from the postfusion conformation and which we refer to as a prefusion conformation. Mutations to stabilize the polypeptide in a prefusion conformation were also discovered. The structures may be used to generate HCMV neutralizing antibody responses greater than those achieved with prior HCMV gB-based immunogens. The polypeptides described herein, and the nucleic acids that encode the polypeptides, may be used, for example, as potential immunogens in a vaccine against HCMV and as diagnostic tools, among other uses.

The inventors further discovered mutations that can be introduced into a cytomegalovirus (CMV) gB polypeptide, which can, among other things, greatly facilitate the production and subsequent purification of a gB antigen stabilized in the prefusion conformation; significantly improve the efficiency of production of a gB polypeptide in the prefusion conformation; alter the antigenicity of a gB polypeptide, as compared to the wild-type gB polypeptide; facilitate a focused immune response to prefusion gB; and reduce and/or eliminate steric occlusion of neutralizing epitopes of gB.

Definitions

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen."

As used herein, the term "additional mutation" shall include, but not be limited to, an amino acid substitution that introduces electrostatic mutations, fill cavities, alter the packing of residues, introduce N-linked glycosylation sites, introduce inter-protomer disulfide bonds, and combinations thereof, including conservative substitutions thereof, as compared to a native HCMV gB. Examples of an "additional mutation" may be found throughout this description but most specifically are set forth in Tables 3 and 4 and the Examples.

The term "adjuvant" refers to a substance capable of enhancing, accelerating, or prolonging the body's immune response to an immunogen or immunogenic composition, such as a vaccine (although it is not immunogenic by itself). An adjuvant may be included in the immunogenic composition, such as a vaccine, or may be administered separately from the immunogenic composition.

The term "administration" refers to the introduction of a substance or composition into a subject by a chosen route.

Administration can be local or systemic. For example, if the chosen route is intramuscular, the composition (such as a composition including a disclosed immunogen) is administered by introducing the composition into a muscle of the subject.

The term "antigen" refers to a molecule that can be recognized by an antibody. Examples of antigens include polypeptides, peptides, lipids, polysaccharides, and nucleic acids containing antigenic determinants, such as those recognized by an immune cell.

The term "conservative substitution" refers to the substitution of an amino acid with a chemically similar amino acid. Conservative amino acid substitutions providing functionally similar amino acids are well known in the art. The following six groups each contain amino acids that are conservative substitutions for one another:

1) alanine (A), serine (S), threonine (T);
2) aspartic acid (D), glutamic acid (E);
3) asparagine (N), glutamine (Q);
4) arginine (R), lysine (K);
5) isoleucine (I), leucine (L), methionine (M), valine (V); and
6) phenylalanine (F), tyrosine (Y), tryptophan (W).

The term "degenerate variant" of a reference polynucleotide refers to a polynucleotide that differs in the nucleotide sequence from the reference polynucleotide but encodes the same polypeptide sequence as encoded by the reference polynucleotide. There are 20 natural amino acids, most of which are specified by more than one codon. For instance, the codons CGU, CGC, CGA, CGG, AGA, and AGG all encode the amino acid arginine. Thus, at every position where an arginine is specified within a protein encoding sequence, the codon can be altered to any of the corresponding codons described without altering the encoded protein. Because of the degeneracy of the genetic code, a large number of functionally identical nucleic acids encode any given polypeptide.

The term "effective amount" refers to an amount of agent that is sufficient to generate a desired response. For instance, this can be the amount necessary to inhibit viral replication or to measurably alter outward symptoms of the viral infection.

The term "epitope" (or "antigenic determinant" or "antigenic site") refers to the region of an antigen to which an antibody, B cell receptor, or T cell receptor binds or responds. Epitopes can be formed from contiguous amino acids or noncontiguous amino acids juxtaposed by secondary, tertiary, or quaternary folding of a protein. Epitopes formed from contiguous amino acids are typically retained on exposure to denaturing solvents whereas epitopes formed by higher order folding are typically lost on treatment with denaturing solvents.

The term "subject" refers to either a human or a non-human mammal. The term "mammal" refers to any animal species of the Mammalia class. Examples of mammals include: humans; non-human primates such as monkeys; laboratory animals such as rats, mice, guinea pigs; domestic animals such as cats, dogs, rabbits, cattle, sheep, goats, horses, and pigs; and captive wild animals such as lions, tigers, elephants, and the like.

The term "glycoprotein" refers to a protein that contains oligosaccharide chains (glycans) covalently attached to polypeptide side-chains. The carbohydrate is attached to the protein in a cotranslational or posttranslational modification known as glycosylation. The term "glycosylation site" refers to an amino acid sequence on the surface of a polypeptide, such as a protein, which accommodates the attachment of a glycan. An N-linked glycosylation site is triplet sequence of NX(S/T) in which N is asparagine, X is any residue except proline, and (S/T) is a serine or threonine residue. A glycan is a polysaccharide or oligosaccharide. Glycan may also be used to refer to the carbohydrate portion of a glycoconjugate, such as a glycoprotein, glycolipid, or a proteoglycan.

The term "host cells" refers to cells in which a vector can be propagated and its DNA or RNA expressed. The cell may be prokaryotic or eukaryotic.

The term "identical" or percent "identity," in the context of two or more nucleic acid or polypeptide sequences, refers to two or more sequences or subsequences that are the same or have a specified percentage of amino acid residues or nucleotides that are the same, when compared and aligned for maximum correspondence. Methods of alignment of sequences for comparison are well known in the art. Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. For example, a peptide sequence that has 1166 matches when aligned with a test sequence having 1554 amino acids is 75.0 percent identical to the test sequence (1166÷1554*100=75.0).

Optimal alignment of sequences for comparison can be conducted, e.g., by the local homology algorithm of Smith and Waterman, Adv. Appl. Math. 2:482, 1981, by the homology alignment algorithm of Needleman and Wunsch, Mol. Biol. 48:443, 1970, by the search for similarity method of Pearson and Lipman, Proc. Nat'l. Acad. Sci. USA 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Sambrook et al. (Molecular Cloning: A Laboratory Manual, 4th ed, Cold Spring Harbor, N.Y., 2012) and Ausubel et al. (In Current Protocols in Molecular Biology, John Wiley and Sons, New York, through supplement 104, 2013).

The term "immunogen" refers to a compound, composition, or substance that is immunogenic as defined herein below.

The term "immunogenic" refers to the ability of a substance to cause, elicit, stimulate, or induce an immune response against a particular antigen, in a subject, whether in the presence or absence of an adjuvant.

The term "immune response" refers to any detectable response of a cell or cells of the immune system of a host mammal to a stimulus (such as an immunogen), including, but not limited to, innate immune responses (e.g., activation of Toll receptor signaling cascade), cell-mediated immune responses (e.g., responses mediated by T cells, such as antigen-specific T cells, and non-specific cells of the immune system), and humoral immune responses (e.g., responses mediated by B cells, such as generation and secretion of antibodies into the plasma, lymph, and/or tissue fluids). Examples of immune responses include an alteration (e.g., increase) in Toll-like receptor activation, lymphokine (e.g., cytokine (e.g., Th1, Th2 or Th17 type cytokines) or chemokine) expression or secretion, macrophage activation, dendritic cell activation, T cell (e.g., CD4+ or CD8+ T cell) activation, NK cell activation, B cell activation (e.g., antibody generation and/or secretion), binding of an immunogen (e.g., antigen (e.g., immunogenic polypeptide)) to an MHC molecule, induction of a cytotoxic T lymphocyte ("CTL") response, induction of a B cell response (e.g., antibody production), and, expansion (e.g., growth of a population of cells) of cells of the immune system (e.g., T cells and B cells), and increased processing and presentation of antigen by antigen presenting cells. The term "immune response" also encompasses any detectable response to a particular substance (such as an antigen or immunogen) by one or more components of the immune system of a vertebrate animal in vitro.

The term 'immunogenic composition" refers to a composition comprising an immunogen.

The term "mutation" refers to deletion, addition, or substitution of amino acid residues in the amino acid sequence of a protein or polypeptide as compared to the amino acid sequence of a reference protein or polypeptide. Throughout the specification and claims, the substitution of an amino acid at one particular location in the protein sequence is referred to using a notation "(amino acid residue in wild type protein)(amino acid position)(amino acid residue in engineered protein)". For example, a notation Y75A refers to a substitution of a tyrosine (Y) residue at the 75th position of the amino acid sequence of the reference protein by an alanine (A) residue (in a mutant of the reference protein). In cases where there is variation in the amino acid residue at the same position among different wild-type sequences, the amino acid code preceding the position number may be omitted in the notation, such as "75A."

The term "native" or "wild-type" protein, sequence, or polypeptide refers to a naturally existing protein, sequence, or polypeptide that has not been artificially modified by selective mutations.

The term "pharmaceutically acceptable carriers" refers to a material or composition which, when combined with an active ingredient, is compatible with the active ingredient and does not cause toxic or otherwise unwanted reactions when administered to a subject, particularly a mammal. Examples of pharmaceutically acceptable carriers include solvents, surfactants, suspending agents, buffering agents, lubricating agents, emulsifiers, absorbants, dispersion media, coatings, and stabilizers.

The term "pre-fusion-specific antibody" refers to an antibody that specifically binds to the CMV gB glycoprotein in a pre-fusion conformation, but does not bind to the CMV gB protein in a post-fusion conformation.

The term "pre-fusion trimer-specific antibody" refers to an antibody that specifically binds to the CMV gB glycoprotein in a pre-fusion, trimeric conformation, but does not bind to the CMV gB protein in a post-fusion conformation or in a pre-fusion conformation that is not also trimeric. "Pre-fusion trimer-specific antibodies" are a subset of "pre-fusion-specific antibodies."

The term "prime-boost vaccination" refers to an immunotherapy regimen that includes administration of a first immunogenic composition (the primer vaccine) followed by administration of a second immunogenic composition (the booster vaccine) to a subject to induce an immune response. The primer vaccine and the booster vaccine typically contain the same immunogen and are presented in the same or similar format. However, they may also be presented in different formats, for example one in the form of a vector and the other in the form of a naked DNA plasmid. The skilled artisan will understand a suitable time interval between administration of the primer vaccine and the booster vaccine. Further, the primer vaccine, the booster vaccine, or both primer vaccine and the booster vaccine additionally include an adjuvant.

The term "soluble protein" refers to a protein capable of dissolving in aqueous liquid and remaining dissolved. The solubility of a protein may change depending on the concentration of the protein in the water-based liquid, the buffering condition of the liquid, the concentration of other solutes in the liquid, for example salt and protein concentrations, and the temperature of the liquid.

The term "specifically bind," in the context of the binding of an antibody to a given target molecule, refers to the binding of the antibody with the target molecule with higher affinity than its binding with other tested substances. For example, an antibody that specifically binds to the CMV gB protein in pre-fusion conformation is an antibody that binds CMV gB protein in pre-fusion conformation with higher affinity than it binds to the CMV gB protein in the post-fusion conformation.

The term "therapeutically effective amount" refers to the amount of agent that is sufficient to prevent, treat (including prophylaxis), reduce and/or ameliorate the symptoms and/or underlying causes of a disorder.

The term "vaccine" refers to a pharmaceutical composition comprising an immunogen that is capable of eliciting a prophylactic or therapeutic immune response in a subject. Typically, a vaccine elicits an antigen-specific immune response to an antigen of a pathogen, for example a viral pathogen.

The term "vector" refers to a nucleic acid molecule capable of transporting or transferring a foreign nucleic acid molecule. The term encompasses both expression vectors and transcription vectors. The term "expression vector" refers to a vector capable of expressing the insert in the target cell, and generally contains control sequences, such as enhancer, promoter, and terminator sequences, that drive expression of the insert. The term "transcription vector" refers to a vector capable of being transcribed but not translated. Transcription vectors are used to amplify their insert. The foreign nucleic acid molecule is referred to as "insert" or "transgene." A vector generally consists of an insert and a larger sequence that serves as the backbone of the vector. Based on the structure or origin of vectors, major types of vectors include plasmid vectors, cosmid vectors, phage vectors such as lambda phage, viral vectors such as adenovirus (Ad) vectors, and artificial chromosomes.

Native HCMV gB

Native HCMV gB is synthesized as a 906 or 907 amino acid polypeptide (depending upon the strain of CMV) that undergoes extensive posttranslational modification, including glycosylation at N- and O-linked sites and cleavage by ubiquitous cellular endoproteases into amino- and carboxy-terminal fragments. The N- and C-terminal fragments of gB, gp116 and gp55, respectively, are covalently connected by disulfide bonds, and the mature, glycosylated gB assumes a trimeric configuration. The gB polypeptide contains a large ectodomain (which is cleaved into gp116 and the ectodomain of gp55), a transmembrane domain (TM), and the intraviral (or cytoplasmic) domain (cytodomain).

Native HCMV gBs from various strains are known. For example, at least sixty HCMV gB sequences from clinical and laboratory-adapted strains are available from NCBI's RefSeq database as described in Burke et al., "Crystal Structure of the Human Cytomegalovirus Glycoprotein B." *PLoS Pathog.* 2015 Oct. 20; 11(10):e1005227, see S4 Fig., which is hereby incorporated herein in its entirety.

Accordingly, the term "CMV gB" polypeptide or "HCMV gB" polypeptide as used herein is to be understood as the native HCMV gB polypeptide from any human HCMV strain (not limited to the Towne strain). The actual residue position number may need to be adjusted for gBs from other human CMV strains depending on the actual sequence alignment. However, one of skill in the art will understand how to align sequences from different strains in order to identify the corresponding residue position from one strain to another.

HCMV gB is encoded by the UL55 gene of HCMV genome. It is an envelope glycoprotein that mediates the fusion of the HCMV viral membrane with a host cell membrane. The protein undergoes a series of conformational changes from a prefusion to a postfusion form. The crystal structure of gB in its postfusion form is available (PDB accession code 5CXF), and the prefusion conformation is set forth herein.

Conformations

A HCMV gB postfusion conformation refers to a structural conformation adopted by HCMV gB subsequent to the fusion of the virus envelope with the host cellular membrane. The native HCMV gB may also assume the postfusion conformation outside the context of a fusion event, for example, under stress conditions such as exposure to heat, extraction from a membrane, expression as an ectodomain or storage. More specifically, the gB postfusion conformation is described, for example, in Burke et al., Crystal Structure of the Human Cytomegalovirus Glycoprotein B. *PLoS Pathog.* 2015 Oct. 20; 11(10): e1005227. See also, Research Collaboratory for Structural Bioinformatics Protein Data Bank (RCSB PDB): 5CXF, Crystal structure of the extracellular domain of glycoprotein B from Human Cytomegalovirus, from Human cytomegalovirus (strain AD169), deposited 2015-07-28; DOI: 10.2210/pdb5CXF/pdb; and Burke et al., *PLoS Pathog.* 2015 Oct. 20; 11(10):e1005227. A sequence of a protein that when expressed, can fold into a postfusion conformation, is provided as SEQ ID NO: 44. Another example of a protein that when expressed folds into a postfusion conformation is provided as SEQ ID NO: 45. The postfusion conformation is about 165 Å tall and 65 Å wide.

As used herein, a "prefusion conformation" refers to a structural conformation adopted by the polypeptide that differs from the HCMV gB postfusion conformation at least in terms of molecular dimensions or three-dimensional coordinates. The prefusion conformation refers to a structural conformation adopted by HCMV gB prior to triggering of the fusogenic event that leads to transition of gB to the postfusion conformation. Isolating HCMV gB in a stable prefusion conformation may be useful in informing and directing development of improved vaccines and immunogenic compositions to address the important public health problem of cytomegalovirus infections. In some embodiments, a prefusion conformation includes a conformation that can bind to a prefusion-specific antibody. In some embodiments, a prefusion conformation includes a conformation that is characterized by coordinates set forth in Table 1A, which is incorporated by reference herein in its entirety. In some embodiments, the polypeptide is characterized by structure coordinates comprising a root mean square deviation (RMSD) of conserved residue backbone atoms when superimposed on backbone atoms described by structural coordinates set forth in Table 1A. In some embodiments, a prefusion conformation includes a conformation that is characterized by coordinates set forth in Table 1B, which is incorporated by reference herein in its entirety. In some embodiments, the polypeptide is characterized by structure coordinates comprising a root mean square deviation (RMSD) of conserved residue backbone atoms when superimposed on backbone atoms described by structural coordinates set forth in Table 1B. In some embodiments, a polypeptide having a HCMV gB prefusion conformation refers to a polypeptide that includes a trimeric helix bundle, centered on the three-fold axis of the trimer and comprising residues L479 to K522 of each protomer, wherein the direction of the bundle from N-terminal to C-terminal along the three-fold axis (shown by the arrows in FIGS. 4A and 4B) is towards the point on the three-fold axis intersected by the plane defined by residue W240 of each protomer, which is in a fusion loop near the tip of each Domain I of the trimer. In some embodiments, the helix bundle comprises the residues between L479 and K522, according to the numbering of SEQ ID NO: 1.

Polypeptides of the Invention

The present invention relates to polypeptides that include amino acid mutations relative to the amino acid sequence of the corresponding wild-type HCMV gB. The amino acid mutations include amino acid substitutions, deletions, or additions relative to a wild-type HCMV gB. Accordingly, the polypeptides are mutants of wild-type HCMV gBs.

In some embodiments, the polypeptides possess certain beneficial characteristics, such as being immunogenic. In some embodiments, the polypeptides possess increased immunogenic properties or improved stability in the prefusion conformation, as compared to the corresponding wild-type HCMV gB. Stability refers to the degree to which a transition of the HCMV gB conformation from prefusion to postfusion is hindered or prevented. In still other embodiments, the present disclosure provides polypeptides that display one or more introduced mutations as described herein, which may also result in improved stability in the prefusion conformation. The introduced amino acid mutations in the HCMV gB include amino acid substitutions, deletions, or additions. In some embodiments, the only mutations in the amino acid sequences of the mutants are amino acid substitutions relative to a wild-type HCMV gB.

Several modes of stabilizing the polypeptide conformation include amino acid substitutions that introduce disulfide bonds, introduce electrostatic mutations, fill cavities, alter the packing of residues, introduce N-linked glycosylation sites, and combinations thereof, as compared to a native HCMV gB.

Figure 3A:
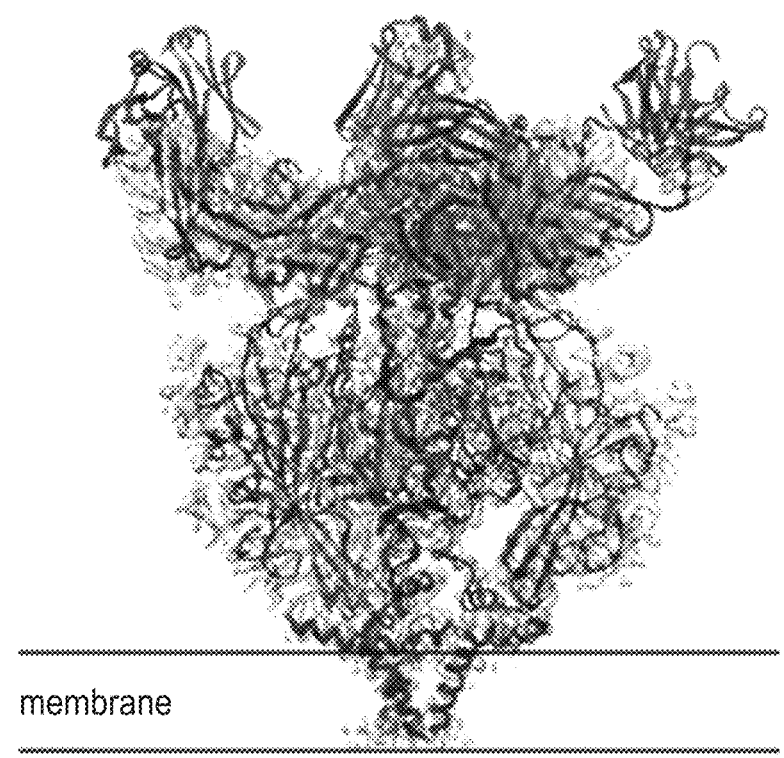
FIG. 3A-3B depict the fitting of models into the density maps. The models of inhibitor compound stabilized prefusion (FIG. 3A) and postfusion gB conformation (FIG. 3B) are fitted into the light gray density maps. gB components are dark gray, and SM5-1 fab components are black. Approximate position of the virus envelope as determined by the position of the TM region in the prefusion structure is indicated by black horizontal lines.

In one aspect, the invention relates to a polypeptide that exhibits a conformation that is not the postfusion conformation. That is, the polypeptide exhibits a prefusion conformation as described above and does not exhibit a postfusion conformation. See, for example, the prefusion conformation illustrated in FIG. 3A, as compared to the postfusion conformation illustrated in FIG. 3B; FIG. 4A, as compared to the postfusion conformation illustrated in FIG. 4B; and FIG. 6A, as compared to the postfusion conformation illustrated in FIG. 6C. In some embodiments, the polypeptide is characterized by structure coordinates comprising a root mean square deviation (RMSD) of conserved residue backbone atoms when superimposed on backbone atoms described by structural coordinates of Table 1A. In some embodiments, the polypeptide is characterized by structure coordinates comprising a root mean square deviation (RMSD) of conserved residue backbone atoms when superimposed on backbone atoms described by structural coordinates of Table 1B.

In some embodiments, the polypeptides are isolated, i.e., separated from HCMV gB polypeptides having a postfusion conformation. Thus, the polypeptide may be, for example, at least 80% isolated, at least 90%, 95%, 98%, 99%, or even 99.9% isolated from HCMV gB polypeptides in a postfusion conformation. In one aspect, the invention relates to a polypeptide that specifically binds to an HCMV gB prefusion-specific antibody.

It will be understood that a homogeneous population of polypeptides in a particular conformation can include variations (such as polypeptide modification variations, e.g., glycosylation state), that do not alter the conformational state of the polypeptide. In several embodiments, the population of polypeptides remains homogeneous over time. For example, in some embodiments, the polypeptide, when dissolved in aqueous solution, forms a population of polypeptides stabilized in the prefusion conformation for at least 12 hours, such as at least 24 hours, at least 48 hours, at least one week, at least two weeks, or more.

Without being bound by theory, the polypeptides disclosed herein are believed to facilitate a stabilized prefusion conformation of an HCMV gB polypeptide. The polypeptides include at least one mutation as compared to a corresponding native HCMV gB polypeptide. A person of ordinary skill in the art will appreciate that the polypeptides are useful to elicit immune responses in mammals to CMV.

The native HCMV gB is conserved among the HCMV entry glycoproteins and is required for entry into all cell types. In view of the substantial conservation of HCMV gB sequences, the amino acid positions amongst different native HCMV gB sequences may be compared to identify corresponding HCMV gB amino acid positions among different HCMV strains. Thus, the conservation of native HCMV gB sequences across strains allows use of a reference HCMV gB sequence for comparison of amino acids at particular positions in the HCMV gB polypeptide. Accordingly, unless expressly indicated otherwise, the polypeptide amino acid positions provided herein refer to the reference sequence of the HCMV gB polypeptide set forth in SEQ ID NO: 1.

However, it should be noted that different native HCMV gB sequences may have different numbering systems from SEQ ID NO: 1, for example, there may be additional amino acid residues added or removed as compared to SEQ ID NO: 1 in a native HCMV gB sequence derived from a strain other than Towne. As such, it is to be understood that when specific amino acid residues are referred to by their number, the description is not limited to only amino acids located at precisely that numbered position when counting from the beginning of a given amino acid sequence, but rather that the equivalent or corresponding amino acid residue in any and all HCMV gB sequences is intended even if that residue is not at the same precise numbered position, for example if the HCMV sequence is shorter (e.g., a fragment) or longer than SEQ ID NO: 1, or has insertions or deletions as compared to SEQ ID NO: 1.

In some embodiments, the polypeptide is full-length, wherein the polypeptide includes the same number of amino acid residues as the mature full-length wild-type HCMV gB. In some embodiments, the polypeptide is a fragment, wherein the polypeptide includes less than the total number of amino acid residues as the mature full-length wild-type HCMV gB. As used herein the term "fragment" and "truncated" are interchangeable. In some embodiments, the truncated gB polypeptide includes only the ectodomain sequence.

1. Cysteine (C) Substitutions

In some embodiments, the polypeptide includes cysteine substitutions that are introduced, as compared to a native HCMV gB. In some embodiments, the polypeptide includes any one of 1, 2, 3, 4, 5, 6, 7, 8, 9, or 10 cysteine substitutions. Without being bound by theory or mechanism, the cysteine substitutions described herein are believed to facilitate stability of the polypeptide in a conformation that is not the HCMV gB postfusion conformation. The introduced cysteine substitutions may be introduced by protein engineering, for example, by including one or more substituted cysteine residues that form a disulfide bond. In several embodiments, the amino acid positions of the cysteines are within a sufficiently close distance for formation of a disulfide bond in the prefusion, and not postfusion, conformation of the HCMV gB.

The cysteine residues that form a disulfide bond can be introduced into native HCMV gB sequence by two or more amino acid substitutions. For example, in some embodiments, two cysteine residues are introduced into a native HCMV gB sequence to form a disulfide bond.

In some embodiments, the polypeptide includes a recombinant HCMV gB stabilized in a prefusion conformation by a disulfide bond between cysteines that are introduced into a pair of amino acid positions that are close to each other in the prefusion conformation and more distant in the postfusion conformation.

Exemplary cysteine substitutions as compared to a native HCMV gB include any mutation selected from Table 2, the numbering of which based on the numbering of SEQ ID NO: 1.

TABLE 2

Exemplary cysteine pairs for disulfide bond stabilization

| Row | (i) Mutant ID | (ii) HCMV gB residue pairs for cysteine substitution, according to the numbering of SEQ ID NO: 1 | (iii) Substitutions corresponding to SEQ ID NO: 1 | (iv) Exemplary sequence that includes the mutations is set forth in: |
|---|---|---|---|---|
| 1 | gB-001; pSB01582 | 98 and 271 | Q98C and G271C | SEQ ID NO: 2 |
| 2 | gB-002 | 98 and 653 | Q98C and I653C | SEQ ID NO: 3 |
| 3 | gB-003; pSB01579 | 99 and 267 | G99C and A267C | SEQ ID NO: 4 |
| 4 | gB-004; pSB01580 | 100 and 267 | T100C and A267C | SEQ ID NO: 5 |
| 5 | gB-005; pSB01581 | 100 and 269 | T100C and S269C | SEQ ID NO: 6 |
| 6 | gB-006 | 100 and 651 | T100C and L651C | SEQ ID NO: 7 |
| 7 | gB-007 | 217 and 584 | D217C and F584C | SEQ ID NO: 8 |
| 8 | gB-008 | 218 and 585 | Y218C and A585C | SEQ ID NO: 9 |
| 9 | gB-009 | 219 and 654 | S219C and D654C | SEQ ID NO: 10 |
| 10 | gB-010 | 220 and 652 | N220C and D652C | SEQ ID NO: 11 |
| 11 | gB-011 | 221 and 652 | T221C and D652C | SEQ ID NO: 12 |
| 12 | gB-012 | 240 and 718 | W240C and G718C | SEQ ID NO: 13 |
| 13 | gB-013 | 242 and 710 | Y242C and K710C | SEQ ID NO: 14 |
| 14 | gB-014 | 242 and 714 | Y242C and D714C | SEQ ID NO: 15 |
| 15 | gB-015 | 269 and 653 | S269C and I653C | SEQ ID NO: 16 |
| 16 | gB-016 | 271 and 614 | G271C and P614C | SEQ ID NO: 17 |
| 17 | gB-017 | 367 and 499 | S367C and L499C | SEQ ID NO: 18 |
| 18 | gB-018 | 372 and 506 | T372C and W506C | SEQ ID NO: 19 |
| 19 | gB-019 | 541 and 669 | F541C and Q669C | SEQ ID NO: 20 |
| 20 | gB-020 | 548 and 650 | L548C and A650C | SEQ ID NO: 21 |
| 21 | gB-021 | 549 and 653 | A549C and I653C | SEQ ID NO: 22 |
| 22 | gB-022 | 550 and 652 | S550C and D652C | SEQ ID NO: 23 |
| 23 | gB-023 | 604 and 661 | G604C and F661C | SEQ ID NO: 24 |
| 24 | gB-024 | 605 and 665 | N605C and E665C | SEQ ID NO: 25 |
| 25 | gB-025 | 607 and 675 | R607C and S675C | SEQ ID NO: 26 |
| 26 | gB-026 | 608 and 679 | T608C and D679C | SEQ ID NO: 27 |
| 27 | gB-027 | 609 and 678 | E609C and F678C | SEQ ID NO: 28 |
| 28 | gB-028 | 673 and 674 | R673C and S674C | SEQ ID NO: 29 |
| 29 | gB-029 | 676 and 677 | N676C and V677C | SEQ ID NO: 30 |
| 30 | gB-030 | 680 and 681 | L680C and E681C | SEQ ID NO: 31 |
| 31 | gB-031 | 683 and 684 | I683C and M684C | SEQ ID NO: 32 |
| 32 | gB-032 | 687 and 688 | F687C and N688C | SEQ ID NO: 33 |
| 33 | gB-033 | 690 and 691 | Y690C and K691C | SEQ ID NO: 34 |

TABLE 2-continued

Exemplary cysteine pairs for disulfide bond stabilization

| Row | (i) Mutant ID | (ii) HCMV gB residue pairs for cysteine substitution, according to the numbering of SEQ ID NO: 1 | (iii) Substitutions corresponding to SEQ ID NO: 1 | (iv) Exemplary sequence that includes the mutations is set forth in: |
|---|---|---|---|---|
| 34 | gB-034 | 695 and 724 | K695C and K724C | SEQ ID NO: 35 |
| 35 | gB-035 | 746 and 747 | T746C and F747C | SEQ ID NO: 36 |
| 36 | gB-036 | 749 and 750 | K749C and N750C | SEQ ID NO: 37 |
| 37 | gB-043; pSB01656 | 96 and 660 | M96C and D660C | SEQ ID NO: 47 |
| 38 | gB-044; pSB01657 | 98 and 658 | Q98C and N658C | SEQ ID NO: 48 |
| 39 | gB-045; pSB01658 | 100 and 258 | T100C and R258C | SEQ ID NO: 49 |
| 40 | gB-046; pSB01659 | 100 and 656 | T100C and L656C | SEQ ID NO: 50 |
| 41 | gB-047; pSB01660 | 100 and 658 | T100C and N658C | SEQ ID NO: 51 |
| 42 | gB-048; pSB01661 | 117 and 406 | I117C and T406C | SEQ ID NO: 52 |
| 43 | gB-049; pSB01662 | 117 and 407 | I117C and S407C | SEQ ID NO: 53 |
| 44 | gB-050; pSB01663 | 153 and 712 | Y153C and L712C | SEQ ID NO: 54 |
| 45 | gB-051; pSB01664 | 162 and 716 | L162C and M716C | SEQ ID NO: 55 |
| 46 | gB-052; pSB01665 | 217 and 587 | D217C and S587C | SEQ ID NO: 56 |
| 47 | gB-053; pSB01666 | 217 and 589 | D217C and Y589C | SEQ ID NO: 57 |
| 48 | gB-054; pSB01667 | 219 and 584 | S219C and F584C | SEQ ID NO: 58 |
| 49 | gB-055; pSB01668 | 219 and 585 | S219C and A585C | SEQ ID NO: 59 |
| 50 | gB-056; pSB01669 | 219 and 586 | S219C and N586C | SEQ ID NO: 60 |
| 51 | gB-057; pSB01670 | 220 and 659 | N220C and T659C | SEQ ID NO: 61 |
| 52 | gB-058; pSB01671 | 223 and 659 | S223C and T659C | SEQ ID NO: 62 |
| 53 | gB-059; pSB01672 | 240 and 732 | W240C and A732C | SEQ ID NO: 63 |
| 54 | gB-060; pSB01673 | 240 and 735 | W240C and G735C | SEQ ID NO: 64 |
| 55 | gB-061; pSB01674 | 242 and 728 | Y242C and V728C | SEQ ID NO: 65 |
| 56 | gB-062; pSB01675 | 242 and 731 | Y242C and G731C | SEQ ID NO: 66 |
| 57 | gB-063 | 258 and 656 | R258C and L656C | SEQ ID NO: 67 |
| 58 | gB-064 | 269 and 656 | S269C and L656C | SEQ ID NO: 68 |
| 59 | gB-065; pSB01678 | 269 and 658 | S269C and N658C | SEQ ID NO: 69 |
| 60 | gB-066; pSB01679 | 272 and 614 | D272C and P614C | SEQ ID NO: 70 |
| 61 | gB-067; pSB01680 | 273 and 629 | V273C and V629C | SEQ ID NO: 71 |
| 62 | gB-068; pSB01681 | 349 and 650 | W349C and A650C | SEQ ID NO: 72 |
| 63 | gB-069; pSB01682 | 367 and 500 | S367C and A500C | SEQ ID NO: 73 |
| 64 | gB-070; pSB01683 | 367 and 503 | S367C and A503C | SEQ ID NO: 74 |
| 65 | gB-071; pSB01684 | 370 and 501 | K370C and Q501C | SEQ ID NO: 75 |
| 66 | gB-072; pSB01685 | 522 and 683 | K522C and I683C | SEQ ID NO: 76 |
| 67 | gB-073; pSB01686 | 523 and 683 | I523C and I683C | SEQ ID NO: 77 |
| 68 | gB-074; pSB01687 | 523 and 684 | I523C and M684C | SEQ ID NO: 78 |
| 69 | gB-075; pSB01688 | 524 and 684 | N524C and M684C | SEQ ID NO: 79 |
| 70 | gB-076 | 525 and 681 | P525C and E681C | SEQ ID NO: 80 |
| 71 | gB-077 | 540 and 680 | R540C and L680C | SEQ ID NO: 81 |
| 72 | gB-078; pSB01691 | 541 and 680 | F541C and L680C | SEQ ID NO: 82 |
| 73 | gB-079; pSB01692 | 548 and 655 | L548C and P655C | SEQ ID NO: 83 |
| 74 | gB-080; pSB01693 | 549 and 658 | A549C and N658C | SEQ ID NO: 84 |
| 75 | gB-081; pSB01694 | 550 and 655 | S550C and P655C | SEQ ID NO: 85 |
| 76 | gB-082; pSB01695 | 550 and 657 | S550C and E657C | SEQ ID NO: 86 |
| 77 | gB-083; pSB01696 | 591 and 668 | Q591C and S668C | SEQ ID NO: 87 |
| 78 | gB-084; pSB01697 | 603 and 667 | L603C and Y667C | SEQ ID NO: 88 |
| 79 | gB-085; pSB01698 | 604 and 672 | G604C and L672C | SEQ ID NO: 89 |
| 80 | gB-086; pSB01699 | 607 and 688 | R607C and N688C | SEQ ID NO: 90 |
| 81 | gB-087; pSB01700 | 608 and 692 | T608C and Q692C | SEQ ID NO: 91 |
| 82 | gB-088; pSB01701 | 609 and 691 | E609C and K691C | SEQ ID NO: 92 |
| 83 | gB-089; pSB01702 | 610 and 674 | E610C and S674C | SEQ ID NO: 93 |
| 84 | gB-090; pSB01703 | 610 and 675 | E610C and S675C | SEQ ID NO: 94 |
| 85 | gB-091; pSB01704 | 612 and 663 | Q612C and V663C | SEQ ID NO: 95 |
| 86 | gB-092; pSB01705 | 737 and 755 | V737C and F755C | SEQ ID NO: 96 |
| 87 | gB-093; pSB01706 | 741 and 754 | V741C and A754C | SEQ ID NO: 97 |
| 88 | gB-094; pSB01707 | 741 and 755 | V741C and F755C | SEQ ID NO: 98 |
| 89 | | 356 and 500 | I356C and A500C | |
| 90 | | 371 and 505 | M371C and A505C | |
| 91 | | 371 and 506 | M371C and W506C | |
| 92 | | 374 and 503 | T374C and A503C | |
| 93 | | 160 and 708 | Y160C and Y708C | |
| 94 | | 221 and 657 | T221C and E657C | |
| 95 | | 541 and 681 | F541C and E681C | |
| 96 | | 605 and 670 | N605C and K670C | |
| 97 | | 219 and 587 | S219C and S587C | |
| 98 | | 219 and 588 | S219C and S588C | |
| 99 | | 219 and 589 | S219C and Y589C | |
| 100 | | 217 and 586 | D217C and N586C | |
| 101 | | 217 and 588 | D217C and S588C | |

In some embodiments, the polypeptide includes one or more (such as 2, 3, 4, 5, 6, 7, 8, 9 or 10) cysteine substitutions at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or 101 of column (ii) of Table 2, wherein the resulting polypeptide does not exhibit an HCMV postfusion conformation.

In some embodiments, the polypeptide includes one or more (such as 2, 3, 4, 5, 6, 7, 8, 9 or 10) cysteine substitutions at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 47, 69 or 91 of column (ii) of Table 2, wherein the resulting polypeptide does not exhibit an HCMV postfusion conformation.

In some embodiments, the polypeptide includes two cysteine substitutions as listed at any one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or 101 of column (ii) of Table 2. In an embodiment, the resulting polypeptide does not exhibit an HCMV postfusion conformation. In an embodiment, the resulting polypeptide exhibits an HCMV prefusion conformation.

In a preferred embodiment, the polypeptide includes cysteine substitutions at positions 98 and 653 (listed in row 2, column (ii) of Table 2) according to the numbering of SEQ ID NO: 1, relative to the amino acid sequence of the wild-type HCMV gB. In another preferred embodiment, the polypeptide includes cysteine substitutions at positions 100 and 269 (listed in row 5, column (ii) of Table 2) according to the numbering of SEQ ID NO: 1, relative to the amino acid sequence of the wild-type HCMV gB. In a further preferred embodiment, the polypeptide includes cysteine substitutions at positions 217 and 584 (listed in row 7, column (ii) of Table 2) according to the numbering of SEQ ID NO: 1, relative to the amino acid sequence of the wild-type HCMV gB. In a preferred embodiment, the polypeptide includes cysteine substitutions at positions 242 and 710 (listed in row 13, column (ii) of Table 2) according to the numbering of SEQ ID NO: 1, relative to the amino acid sequence of the wild-type HCMV gB. In another preferred embodiment, the polypeptide includes cysteine substitutions at positions 242 and 714 (listed in row 14, column (ii) of Table 2) according to the numbering of SEQ ID NO: 1, relative to the amino acid sequence of the wild-type HCMV gB. In a further preferred embodiment, the polypeptide includes cysteine substitutions at positions 367 and 499 (listed in row 17, column (ii) of Table 2) according to the numbering of SEQ ID NO: 1, relative to the amino acid sequence of the wild-type HCMV gB. In a preferred embodiment, the polypeptide includes cysteine substitutions at positions 372 and 506 (listed in row 18, column (ii) of Table 2) according to the numbering of SEQ ID NO: 1, relative to the amino acid sequence of the wild-type HCMV gB. In another preferred embodiment, the polypeptide includes cysteine substitutions at positions 550 and 652 (listed in row 22, column (ii) of Table 2) according to the numbering of SEQ ID NO: 1, relative to the amino acid sequence of the wild-type HCMV gB. In a further preferred embodiment, the polypeptide includes cysteine substitutions at positions 608 and 679 (listed in row 26, column (ii) of Table 2) according to the numbering of SEQ ID NO: 1, relative to the amino acid sequence of the wild-type HCMV gB. In a preferred embodiment, the polypeptide includes cysteine substitutions at positions 695 and 724 (listed in row 34, column (ii) of Table 2) according to the numbering of SEQ ID NO: 1, relative to the amino acid sequence of the wild-type HCMV gB.

In some embodiments, the polypeptide includes one or more (such as 2, 3, 4, 5, 6, 7, 8, 9 or 10) disulfide bonds between pairs of cysteine residues substituted at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 and 101 of column (ii) of Table 2. In a preferred embodiment, the polypeptide includes a disulfide bond between a pair of cysteine residues substituted at positions 98 and 653 (listed in row 2, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 100 and 269 (listed in row 5, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 217 and 584 (listed in row 7, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 710 (listed in row 13, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 242 and 714 (listed in row 14, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 367 and 499 (listed in row 17, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 372 and 506 (listed in row 18, column (ii) of Table 2) according to the numbering of SEQ ID NO: 1, relative to the amino acid sequence of the wild-type HCMV gB. In another preferred embodiment, the polypeptide includes a disulfide bond between a pair of cysteine residues substituted at positions 550 and 652 (listed in row 22, column (ii) of Table 2) according to the numbering of SEQ ID NO: 1, relative to the amino acid sequence of the wild-type HCMV gB. In a further preferred embodiment, the polypeptide includes a disulfide bond between a pair of cysteine residues substituted at positions 608 and 679 (listed in row 26, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 695 and 724 (listed in row 34, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 217 and 589 (listed in row 47, column (ii)

of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 524 and 684 (listed in row 69, column (ii) of Table 2) according to the numbering of SEQ ID NO: 1, relative to the amino acid sequence of the wild-type HCMV gB. In a preferred embodiment, the polypeptide includes a disulfide bond between a pair of cysteine residues substituted at positions 371 and 506 (listed in row 91, column (ii) of Table 2) according to the numbering of SEQ ID NO: 1, relative to the amino acid sequence of the wild-type HCMV gB.

In further embodiments, the polypeptide includes one or more (such as 2, 3, 4, 5, 6, 7, 8, 9 or 10) disulfide bonds between pairs of cysteine residues that are introduced by cysteine amino acid substitutions at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, or 36 of column (iii) of Table 2, wherein the polypeptide does not exhibit an HCMV postfusion conformation.

In further embodiments, the polypeptide includes one or more (such as 2, 3, 4, 5, 6, 7, 8, 9 or 10) disulfide bonds between pairs of cysteine residues that are introduced by cysteine amino acid substitutions at any one of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69 70, 71 72, 73, 74, 75, 76, 77, 78, 79, 80, 81, 82, 83, 84, 85, 86, 87, 88, 89, 90, 91, 92, 93, 94, 95, 96, 97, 98, 99, 100 or 101 of column (iii) of Table 2, wherein the polypeptide does not exhibit an HCMV postfusion conformation.

In some embodiments, the polypeptide includes a disulfide bond between pairs of cysteine residues substituted at any one of the pairs of positions listed at any one of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or 101 of column (ii) of Table 2. In an embodiment, the resulting polypeptide does not exhibit an HCMV postfusion conformation. In an embodiment, the resulting polypeptide exhibits an HCMV prefusion conformation.

In a preferred embodiment, the polypeptide includes cysteine substitutions at Q98C and I653C (listed in row 2, column (iii) of Table 2) according to the numbering of SEQ ID NO: 1, relative to the amino acid sequence of the wild-type HCMV gB. In another preferred embodiment, the polypeptide includes cysteine substitutions at T100C and S269C (listed in row 5, column (iii) of Table 2) according to the numbering of SEQ ID NO: 1, relative to the amino acid sequence of the wild-type HCMV gB. In a further preferred embodiment, the polypeptide includes cysteine substitutions at D217C and F584C (listed in row 7, column (iii) of Table 2) according to the numbering of SEQ ID NO: 1, relative to the amino acid sequence of the wild-type HCMV gB. In a preferred embodiment, the polypeptide includes cysteine substitutions at Y242C and K710C (listed in row 13, column (iii) of Table 2) according to the numbering of SEQ ID NO: 1, relative to the amino acid sequence of the wild-type HCMV gB. In another preferred embodiment, the polypeptide includes cysteine substitutions at Y242C and D714C (listed in row 14, column (iii) of Table 2) according to the numbering of SEQ ID NO: 1, relative to the amino acid sequence of the wild-type HCMV gB. In a further preferred embodiment, the polypeptide includes cysteine substitutions at S367C and L499C (listed in row 17, column (iii) of Table 2) according to the numbering of SEQ ID NO: 1, relative to the amino acid sequence of the wild-type HCMV gB. In a preferred embodiment, the polypeptide includes cysteine substitutions at T372C and W506C (listed in row 18, column (iii) of Table 2) according to the numbering of SEQ ID NO: 1, relative to the amino acid sequence of the wild-type HCMV gB. In another preferred embodiment, the polypeptide includes cysteine substitutions at S550C and D652C (listed in row 22, column (iii) of Table 2) according to the numbering of SEQ ID NO: 1, relative to the amino acid sequence of the wild-type HCMV gB. In a further preferred embodiment, the polypeptide includes cysteine substitutions at T608C and D679C (listed in row 26, column (iii) of Table 2) according to the numbering of SEQ ID NO: 1, relative to the amino acid sequence of the wild-type HCMV gB. In a preferred embodiment, the polypeptide includes cysteine substitutions at K695C and K724C (listed in row 34, column (iii) of Table 2) according to the numbering of SEQ ID NO: 1, relative to the amino acid sequence of the wild-type HCMV gB. In a preferred embodiment, the polypeptide includes cysteine substitutions at D217C and Y589C (listed in row 47, column (ili) of Table 2) according to the numbering of SEQ ID NO: 1, relative to the amino acid sequence of the wild-type HCMV gB. In a preferred embodiment, the polypeptide includes cysteine substitutions at N524C and M684C (listed in row 69, column (iil) of Table 2) according to the numbering of SEQ ID NO: 1, relative to the amino acid sequence of the wild-type HCMV gB. In a preferred embodiment, the polypeptide includes cysteine substitutions at M371C and W506C (listed in row 91, column (ili) of Table 2) according to the numbering of SEQ ID NO: 1, relative to the amino acid sequence of the wild-type HCMV gB.

In a preferred embodiment, the polypeptide includes a disulfide bond between a pair of cysteine residues substituted at positions 96 and 660 according to the numbering of SEQ ID NO: 1, relative to the amino acid sequence of the wild-type HCMV gB. In another preferred embodiment, the polypeptide includes a disulfide bond between a pair of cysteine residues substituted at positions 98 and 658 according to the numbering of SEQ ID NO: 1, relative to the amino acid sequence of the wild-type HCMV gB. In a further preferred embodiment, the polypeptide includes a disulfide bond between a pair of cysteine residues substituted at positions 100 and 258 according to the numbering of SEQ ID NO: 1, relative to the amino acid sequence of the wild-type HCMV gB. In a preferred embodiment, the polypeptide includes a disulfide bond between a pair of cysteine residues substituted at positions 100 and 656 according to the numbering of SEQ ID NO: 1, relative to the amino acid sequence of the wild-type HCMV gB. In another preferred embodiment, the polypeptide includes a disulfide bond between a pair of cysteine residues substituted at positions 100 and 658 according to the numbering of SEQ ID NO: 1, relative to the amino acid sequence of the wild-type HCMV gB. In a further preferred embodiment, the polypeptide includes a disulfide bond between a pair of cysteine residues substituted at positions 117 and 406 according to the numbering of SEQ ID NO: 1, relative to the amino acid sequence of the wild-type HCMV gB. In a preferred embodiment, the polypeptide includes a disulfide bond between a pair of cysteine residues substituted at positions 117 and 407 according to the numbering of SEQ ID NO: 1, relative to the amino acid sequence of the wild-type HCMV gB. In a preferred embodiment, the polypeptide includes a disulfide bond between a pair of cysteine residues substituted at positions 153 and 712 according to the numbering of SEQ ID NO: 1, relative to the amino acid sequence of the wild-type HCMV gB. In a preferred embodiment, the polypeptide includes a disulfide bond between a pair of cysteine residues substituted at positions 162 and 716 according to the numbering of SEQ ID NO: 1, relative to the amino acid sequence of the wild-type HCMV gB. In a preferred embodiment, the polypeptide includes a disulfide bond between a pair of cysteine residues substituted at positions 217 and 587 according to the numbering of SEQ ID NO: 1, relative to the amino acid sequence of the wild-type HCMV gB. In a preferred embodiment, the polypeptide includes a disulfide bond between a pair of cysteine residues substituted at positions 217 and 589 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 584 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 585 according to the numbering of SEQ ID NO: 1, relative to the amino acid sequence of the wild-type HCMV gB. In a preferred embodiment, the polypeptide includes a disulfide bond between a pair of cysteine residues substituted at positions 219 and 586 according to the numbering of SEQ ID NO: 1, relative to the amino acid sequence of the wild-type HCMV gB. In a preferred embodiment, the polypeptide includes a disulfide bond between a pair of cysteine residues substituted at positions 220 and 659 according to the numbering of SEQ ID NO: 1, relative to the amino acid sequence of the wild-type HCMV gB. In a preferred embodiment, the polypeptide includes a disulfide bond between a pair of cysteine residues substituted at positions 223 and 659 according to the numbering of SEQ ID NO: 1, relative to the amino acid sequence of the wild-type HCMV gB. In a preferred embodiment, the polypeptide includes a disulfide bond between a pair of cysteine residues substituted at positions 240 and 732 according to the numbering of SEQ ID NO: 1, relative to the amino acid sequence of the wild-type HCMV gB. In a preferred embodiment, the polypeptide includes a disulfide bond between a pair of cysteine residues substituted at positions 240 and 735 according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 728 according to the numbering of SEQ ID NO: 1, relative to the amino acid sequence of the wild-type HCMV gB. In a preferred embodiment, the polypeptide includes a disulfide bond between a pair of cysteine residues substituted at positions 242 and 731 according to the numbering of SEQ ID NO: 1, relative to the amino acid sequence of the wild-type HCMV gB. In a preferred embodiment, the polypeptide includes a disulfide bond between a pair of cysteine residues substituted at positions 258 and 656 according to the numbering of SEQ ID NO: 1, relative to the amino acid sequence of the wild-type HCMV gB. In a preferred embodiment, the polypeptide includes a disulfide bond between a pair of cysteine residues substituted at positions 269 and 656 according to the numbering of SEQ ID NO: 1, relative to the amino acid sequence of the wild-type HCMV gB. In a preferred embodiment, the polypeptide includes a disulfide bond between a pair of cysteine residues substituted at positions 269 and 658 according to the numbering of SEQ ID NO: 1, relative to the amino acid sequence of the wild-type HCMV gB. In a preferred embodiment, the polypeptide includes a disulfide bond between a pair of cysteine residues substituted at positions 272 and 614 according to the numbering of SEQ ID NO: 1, relative to the amino acid sequence of the wild-type HCMV gB. In a preferred embodiment, the polypeptide includes a disulfide bond between a pair of cysteine residues substituted at positions 273 and 629 according to the numbering of SEQ ID NO: 1, relative to the amino acid sequence of the wild-type HCMV gB. In a preferred embodiment, the polypeptide includes a disulfide bond between a pair of cysteine residues substituted at positions 349 and 650 according to the numbering of SEQ ID NO: 1, relative to the amino acid sequence of the wild-type HCMV gB. In a preferred embodiment, the polypeptide includes a disulfide bond between a pair of cysteine residues substituted at positions 367 and 500 according to the numbering of SEQ ID NO: 1, relative to the amino acid sequence of the wild-type HCMV gB. In a preferred embodiment, the polypeptide includes a disulfide bond between a pair of cysteine residues substituted at positions 367 and 503 according to the numbering of SEQ ID NO: 1, relative to the amino acid sequence of the wild-type HCMV gB. In a preferred embodiment, the polypeptide includes a disulfide bond between a pair of cysteine residues substituted at positions 370 and 501 according to the numbering of SEQ ID NO: 1, relative to the amino acid sequence of the wild-type HCMV gB. In a preferred embodiment, the polypeptide includes a disulfide bond between a pair of cysteine residues substituted at positions 522 and 683 according to the numbering of SEQ ID NO: 1, relative to the amino acid sequence of the wild-type HCMV gB. In a preferred embodiment, the polypeptide includes a disulfide bond between a pair of cysteine residues substituted at positions 523 and 683 according to the numbering of SEQ ID NO: 1, relative to the amino acid sequence of the wild-type HCMV gB. In a preferred embodiment, the polypeptide includes a disulfide bond between a pair of cysteine residues substituted at positions 523 and 684 according to the numbering of SEQ ID NO: 1, relative to the amino acid sequence of the wild-type HCMV gB. In a preferred embodiment, the polypeptide includes a disulfide bond between a pair of cysteine residues substituted at positions 524 and 684 according to the numbering of SEQ ID NO: 1, relative to the amino acid sequence of the wild-type HCMV gB. In a preferred embodiment, the polypeptide includes a disulfide bond between a pair of cysteine residues substituted at positions 525 and 681 according to the numbering of SEQ ID NO: 1, relative to the amino acid sequence of the wild-type HCMV gB. In a preferred embodiment, the polypeptide includes a disulfide bond between a pair of cysteine residues substituted at positions 540 and 680 according to the numbering of SEQ ID NO: 1, relative to the amino acid sequence of the wild-type HCMV gB. In a preferred embodiment, the polypeptide includes a disulfide bond between a pair of cysteine residues substituted at positions 541 and 680 according to the numbering of SEQ ID NO: 1, relative to the amino acid sequence of the wild-type HCMV gB. In a preferred embodiment, the polypeptide includes a disulfide bond between a pair of cysteine residues substituted at positions 548 and 655 according to the numbering of SEQ ID NO: 1, relative to the amino acid sequence of the wild-type HCMV gB. In a preferred embodiment, the polypeptide includes a disulfide bond between a pair of cysteine residues substituted at positions 549 and 658 according to the numbering of SEQ ID NO: 1, relative to the amino acid sequence of the wild-type HCMV gB. In a preferred embodiment, the polypeptide includes a disulfide bond between a pair of cysteine residues substituted at positions 550 and 655 according to the numbering of SEQ ID NO: 1, relative to the amino acid sequence of the wild-type HCMV gB. In a preferred embodiment, the polypeptide includes a disulfide bond between a pair of cysteine residues substituted at positions 550 and 657 according to the numbering of SEQ ID NO: 1, relative to the amino acid sequence of the wild-type HCMV gB. In a preferred embodiment, the polypeptide includes a disulfide bond between a pair of cysteine residues substituted at positions 591 and 668 according to the numbering of SEQ ID NO: 1, relative to the amino acid sequence of the wild-type HCMV gB. In a preferred embodiment, the polypeptide includes a disulfide bond between a pair of cysteine residues substituted at positions 603 and 667 according to the numbering of SEQ ID NO: 1, relative to the amino acid sequence of the wild-type HCMV gB. In a preferred embodiment, the polypeptide includes a disulfide bond between a pair of cysteine residues substituted at positions 604 and 672 according to the numbering of SEQ ID NO: 1, relative to the amino acid sequence of the wild-type HCMV gB. In a preferred embodiment, the polypeptide includes a disulfide bond between a pair of cysteine residues substituted at positions 607 and 688 according to the numbering of SEQ ID NO: 1, relative to the amino acid sequence of the wild-type HCMV gB. In a preferred embodiment, the polypeptide includes a disulfide bond between a pair of cysteine residues substituted at positions 608 and 692 according to the numbering of SEQ ID NO: 1, relative to the amino acid sequence of the wild-type HCMV gB. In a preferred embodiment, the polypeptide includes a disulfide bond between a pair of cysteine residues substituted at positions 609 and 691 according to the numbering of SEQ ID NO: 1, relative to the amino acid sequence of the wild-type HCMV gB. In a preferred embodiment, the polypeptide includes a disulfide bond between a pair of cysteine residues substituted at positions 610 and 674 according to the numbering of SEQ ID NO: 1, relative to the amino acid sequence of the wild-type HCMV gB. In a preferred embodiment, the polypeptide includes a disulfide bond between a pair of cysteine residues substituted at positions 610 and 675 according to the numbering of SEQ ID NO: 1, relative to the amino acid sequence of the wild-type HCMV gB. In a preferred embodiment, the polypeptide includes a disulfide bond between a pair of cysteine residues substituted at positions 612 and 663 according to the numbering of SEQ ID NO: 1, relative to the amino acid sequence of the wild-type HCMV gB. In a preferred embodiment, the polypeptide includes a disulfide bond between a pair of cysteine residues substituted at positions 737 and 755 according to the numbering of SEQ ID NO: 1, relative to the amino acid sequence of the wild-type HCMV gB. In a preferred embodiment, the polypeptide includes a disulfide bond between a pair of cysteine residues substituted at positions 741 and 754 according to the numbering of SEQ ID NO: 1, relative to the amino acid sequence of the wild-type HCMV gB. In a preferred embodiment, the polypeptide includes a disulfide bond between a pair of cysteine residues substituted at positions 741 and 755 according to the numbering of SEQ ID NO: 1, relative to the amino acid sequence of the wild-type HCMV gB.

In some embodiments, the polypeptide includes a combination of two or more of the disulfide bonds between cysteine residues listed in Table 2. In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 2; SEQ ID NO: 3; SEQ ID NO: 4; SEQ ID NO: 5; SEQ ID NO: 6; SEQ ID NO: 7; SEQ ID NO: 8; SEQ ID NO: 9; SEQ ID NO: 10; SEQ ID NO: 11; SEQ ID NO: 12; SEQ ID NO: 13; SEQ ID NO: 14; SEQ ID NO: 15; SEQ ID NO: 16; SEQ ID NO: 17; SEQ ID NO: 18; SEQ ID NO: 19; SEQ ID NO: 20; SEQ ID NO: 21; SEQ ID NO: 22; SEQ ID NO: 23; SEQ ID NO: 24; SEQ ID NO: 25; SEQ ID NO: 26; SEQ ID NO: 27; SEQ ID NO: 28; SEQ ID NO: 29; SEQ ID NO: 30; SEQ ID NO: 31; SEQ ID NO: 32; SEQ ID NO: 33; SEQ ID NO: 34; SEQ ID NO: 35; SEQ ID NO: 36; and SEQ ID NO: 37.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, and SEQ ID NO: 98.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, preferably 99%, or 100% identity to any sequence selected from SEQ ID NO: 56, SEQ ID NO: 57, SEQ ID NO: 58, and SEQ ID NO: 60.

In some embodiments, the polypeptide includes an amino acid sequence having at least 80%, 81%, 82%, 83%, 84%, 85%, 86%, 87%, 88%, 89%, 90%, 91%, 92%, 93%, 94%, 95%, 96%, 97%, 98%, preferably 99%, or 100% identity to any sequence selected from SEQ ID NO: 51, SEQ ID NO: 73, SEQ ID NO: 70, and SEQ ID NO: 78.

In some embodiments, the composition preferably does not include a polypeptide having the sequence set forth in any one of SEQ ID NO: 59, SEQ ID NO: 75, SEQ ID NO: 76, SEQ ID NO: 71, SEQ ID NO: 52, SEQ ID NO: 96, and SEQ ID NO: 50.

In additional embodiments, the polypeptide includes the amino acid sequence as set forth in any one of the SEQ ID NOs listed in column (iv) of Table 2. That is, an exemplary polypeptide includes a polypeptide having the amino acid sequence selected from any one of: SEQ ID NO: 2; SEQ ID NO: 3; SEQ ID NO: 4; SEQ ID NO: 5; SEQ ID NO: 6; SEQ ID NO: 7; SEQ ID NO: 8; SEQ ID NO: 9; SEQ ID NO: 10; SEQ ID NO: 11; SEQ ID NO: 12; SEQ ID NO: 13; SEQ ID NO: 14; SEQ ID NO: 15; SEQ ID NO: 16; SEQ ID NO: 17; SEQ ID NO: 18; SEQ ID NO: 19; SEQ ID NO: 20; SEQ ID NO: 21; SEQ ID NO: 22; SEQ ID NO: 23; SEQ ID NO: 24; SEQ ID NO: 25; SEQ ID NO: 26; SEQ ID NO: 27; SEQ ID NO: 28; SEQ ID NO: 29; SEQ ID NO: 30; SEQ ID NO: 31; SEQ ID NO: 32; SEQ ID NO: 33; SEQ ID NO: 34; SEQ ID NO: 35; SEQ ID NO: 36; and SEQ ID NO: 37.

In some embodiments, the polypeptide has the amino acid sequence selected from any one of SEQ ID NO: 47, SEQ ID NO: 48, SEQ ID NO: 49, SEQ ID NO: 50, SEQ ID NO: 51, SEQ ID NO: 52, SEQ ID NO: 53, SEQ ID NO: 54, SEQ ID NO: 55, SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, and SEQ ID NO: 98.

In a preferred embodiment, the polypeptide includes the amino acid sequence as set forth in any one of SEQ ID NO: 3; SEQ ID NO: 6; SEQ ID NO: 8; SEQ ID NO: 14; SEQ ID NO: 15; SEQ ID NO: 18; SEQ ID NO: 19; SEQ ID NO: 23; SEQ ID NO: 27; and SEQ ID NO: 35.

In some embodiments, the polypeptide comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity to amino acids 23 to 907 of SEQ ID NO: 1. In an embodiment, the polypeptide comprises an amino acid sequence having at least 90% identity to amino acids 23 to 907 of SEQ ID NO: 1. In an embodiment, the polypeptide comprises an amino acid sequence having at least 94% identity to amino acids 23 to 907 of SEQ ID NO: 1. In an embodiment, the polypeptide comprises an amino acid sequence having at least 95% identity to amino acids 23 to 907 of SEQ ID NO: 1. In an embodiment, the polypeptide comprises an amino acid sequence having at least 96% identity to amino acids 23 to 907 of SEQ ID NO: 1. In an embodiment, the polypeptide comprises an amino acid sequence having at least 97% identity to amino acids 23 to 907 of SEQ ID NO: 1. In an embodiment, the polypeptide comprises an amino acid sequence having at least 97% identity to amino acids 23 to 907 of SEQ ID NO: 1. In an embodiment, the polypeptide comprises an amino acid sequence having at least 98% identity to amino acids 23 to 907 of SEQ ID NO: 1. In an embodiment, the polypeptide comprises an amino acid sequence having at least 99% identity to amino acids 23 to 907 of SEQ ID NO: 1. In an embodiment, the polypeptide comprises an amino acid sequence having at least 99.5% identity to amino acids 23 to 907 of SEQ ID NO: 1. In an embodiment, the polypeptide comprises an amino acid sequence having at least 99.6% identity to amino acids 23 to 907 of SEQ ID NO: 1. In an embodiment, the polypeptide comprises an amino acid sequence having at least 99.7% identity to amino acids 23 to 907 of SEQ ID NO: 1. In an embodiment, the polypeptide comprises an amino acid sequence having at least 99.8% identity to amino acids 23 to 907 of SEQ ID NO: 1. In an embodiment, the polypeptide comprises an amino acid sequence having at least 99.85% identity to amino acids 23 to 907 of SEQ ID NO: 1.

In some embodiments, the polypeptide comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity to amino acids 23 to 707 of SEQ ID NO: 1. In an embodiment, the polypeptide comprises an amino acid sequence having at least 90% identity to amino acids 23 to 707 of SEQ ID NO: 1. In an embodiment, the polypeptide comprises an amino acid sequence having at least 94% identity to amino acids 23 to 707 of SEQ ID NO: 1. In an embodiment, the polypeptide comprises an amino acid sequence having at least 95% identity to amino acids 23 to 707 of SEQ ID NO: 1. In an embodiment, the polypeptide comprises an amino acid sequence having at least 96% identity to amino acids 23 to 707 of SEQ ID NO: 1. In an embodiment, the polypeptide comprises an amino acid sequence having at least 97% identity to amino acids 23 to 707 of SEQ ID NO: 1. In an embodiment, the polypeptide comprises an amino acid sequence having at least 97% identity to amino acids 23 to 707 of SEQ ID NO: 1. In an embodiment, the polypeptide comprises an amino acid sequence having at least 98% identity to amino acids 23 to 707 of SEQ ID NO: 1. In an embodiment, the polypeptide comprises an amino acid sequence having at least 99% identity to amino acids 23 to 707 of SEQ ID NO: 1. In an embodiment, the polypeptide comprises an amino acid sequence having at least 99.5% identity to amino acids 23 to 707 of SEQ ID NO: 1. In an embodiment, the polypeptide comprises an amino acid sequence having at least 99.6% identity to amino acids 23 to 707 of SEQ ID NO: 1. In an embodiment, the polypeptide comprises an amino acid sequence having at least 99.7% identity to amino acids 23 to 707 of SEQ ID NO: 1. In an embodiment, the polypeptide comprises an amino acid sequence having at least 99.8% identity to amino acids 23 to 707 of SEQ ID NO: 1. In an embodiment, the polypeptide comprises an amino acid sequence having at least 99.85% identity to amino acids 23 to 707 of SEQ ID NO: 1.

In some embodiments, the polypeptide comprises an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity to amino acids 23 to 646 of SEQ ID NO: 1. In an embodiment, the polypeptide comprises an amino acid sequence having at least 90% identity to amino acids 23 to 646 of SEQ ID NO: 1. In an embodiment, the polypeptide comprises an amino acid sequence having at least 94% identity to amino acids 23 to 646 of SEQ ID NO: 1. In an embodiment, the polypeptide comprises an amino acid sequence having at least 95% identity to amino acids 23 to 646 of SEQ ID NO: 1. In an embodiment, the polypeptide comprises an amino acid sequence having at least 96% identity to amino acids 23 to 646 of SEQ ID NO: 1. In an embodiment, the polypeptide comprises an amino acid sequence having at least 97% identity to amino acids 23 to 646 of SEQ ID NO: 1. In an embodiment, the polypeptide comprises an amino acid sequence having at least 97% identity to amino acids 23 to 646 of SEQ ID NO: 1. In an embodiment, the polypeptide comprises an amino acid sequence having at least 98% identity to amino acids 23 to 646 of SEQ ID NO: 1. In an embodiment, the polypeptide comprises an amino acid sequence having at least 99% identity to amino acids 23 to 646 of SEQ ID NO: 1. In an embodiment, the polypeptide comprises an amino acid sequence having at least 99.5% identity to amino acids 23 to 646 of SEQ ID NO: 1. In an embodiment, the polypeptide comprises an amino acid sequence having at least 99.6% identity to amino acids 23 to 646 of SEQ ID NO: 1. In an embodiment, the polypeptide comprises an amino acid sequence having at least 99.7% identity to amino acids 23 to 646 of SEQ ID NO: 1. In an embodiment, the polypeptide comprises an amino acid sequence having at least 99.8% identity to amino acids 23 to 646 of SEQ ID NO: 1. In an embodiment, the polypeptide comprises an amino acid sequence having at least 99.85% identity to amino acids 23 to 646 of SEQ ID NO: 1.

In some embodiments, amino acids can be inserted (or deleted) from the native HCMV gB sequence to adjust the alignment of residues in the polypeptide structure, such that particular residue pairs are within a sufficiently close distance to form a disulfide bond in the prefusion, but not postfusion, conformation. In several such embodiments, the polypeptide includes a disulfide bond between cysteine residues located at any of the pairs of positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or 101 of column (ii) of Table 2, in addition to including at least one amino acid insertion.

In some embodiments, the polypeptide includes a phenylalanine substitution as compared to a native HCMV gB. In some embodiments, the polypeptide includes a leucine substitution as compared to a native HCMV gB. In some embodiments, the polypeptide may be stabilized by amino acid mutations (such as, for example, phenylalanine (F) and leucine (L) substitutions) that decrease ionic repulsion between resides that are proximate to each other in the folded structure of the polypeptide, as compared to a HCMV gB polypeptide in postfusion conformation. In some embodiments, the polypeptide may be stabilized by amino acid mutations that increase ionic attraction between residues that are proximate to each other in the folded structure of the polypeptide, as compared to a HCMV gB in postfusion conformation.

Exemplary mutations include any mutation selected from Table 3, according to the numbering of SEQ ID NO: 1 as compared to a native HCMV gB:

TABLE 3

Exemplary Phenylalanine (F) and Leucine (L) Substitutions

| Row | (i) Mutant ID | (ii) Mutated residue position, according to the numbering of SEQ ID NO: 1 | (iii) Substitutions corresponding to SEQ ID NO: 1 | (iv) Exemplary sequence that includes the mutation is set forth in: |
|---|---|---|---|---|
| 1 | gB-037 | 670 | K670L | SEQ ID NO: 38 |
| 2 | gB-038 | 670 | K670F | SEQ ID NO: 39 |
| 3 | gB-039 | 673 | R673L | SEQ ID NO: 40 |
| 4 | gB-040 | 673 | R673F | SEQ ID NO: 41 |
| 5 | gB-041 | 691 | K691L | SEQ ID NO: 42 |
| 6 | gB-042 | 691 | K691F | SEQ ID NO: 43 |
| 7 | pSB02041 | 686 | E686F | |
| 8 | | 686 | E686L | |
| 9 | | 354 | R354F | |
| 10 | | 573 | R573F | |
| 11 | | 101 and 260 | D101L and K260L | |

TABLE 4

Additional substitutions

| Row | (i) Mutant ID | (ii) Mutated residue position, according to the numbering of SEQ ID NO: 1 | (iii) Substitutions corresponding to SEQ ID NO: 1 | (iv) Exemplary sequence that includes the mutation is set forth in: |
|---|---|---|---|---|
| 1 | gB-095; pSB01708 | 679 | D679S | SEQ ID NO: 99 |
| 2 | gB-096; pSB01709 | 679 | D679N | SEQ ID NO: 100 |
| 3 | gB-097 | 682 | E682S | SEQ ID NO: 101 |
| 4 | gB-098 | 682 | E682Q | SEQ ID NO: 102 |
| 5 | gB-099; pSB01712 | 686 | E686S | SEQ ID NO: 103 |
| 6 | gB-100; pSB01713 | 686 | E686Q | SEQ ID NO: 104 |
| 7 | gB-101 | 118 | N118P | SEQ ID NO: 105 |
| 8 | gB-102; pSB01715 | 646 | D646P | SEQ ID NO: 106 |
| 9 | | 240 | W240A | |
| 10 | | 246 | C246S | |
| 11 | | 675 | I675S | |
| 12 | | 155-157 | Y155G I156H H157R | |
| 13 | pSB02043 | 686 | E686I | |
| 14 | pSB02044 | 686 | E686V | |
| 15 | | 679 | D679A | |
| 16 | | 696 and 697 | Y696C and V697C | |
| 17 | | 703 and 704 | D703C and P704C | |
| 18 | | 767 and 768 | I767C and I768C | |
| 19 | | 217, 589, 703, and 704 | D217C, Y589C, D703C, and P704C | |
| 20 | | 217, 589, 696, and 697 | D217C, Y589C, Y696C, and V697C | |
| 21 | pSB2795 | 217, 371, 506, 524 and 589 | D217C, M371C, W506C, N524C and Y589C | |
| 22 | pSB2796 | 217, 371, 506, and 589 | D217C, M371C, W506C, and Y589C | |
| 23 | | 217, 524, 589, and 684 | D217C, N524C, Y589C, M684C | |
| 24 | | 217, 524, 589, 684, 703, and 704 | D217C, N524C, Y589C, M684C, D703C, and P704C | |
| 25 | | 655 | P655S | |
| 26 | pSB2797; pSB2968 | 217, 371, 506, 524 589 and 684 | D217C, M371C, W506C, N524C Y589C and M684C | |
| 27 | pSB2797; pSB2968 | 648 -653 | M648G I649S A650G L651K D652D I653G | |
| 28 | | 693 | R693V | |
| 29 | | 685 | R685A | |
| 30 | | 678 | F678S | |
| 31 | | 680 | L680T | |

In some embodiments, the polypeptide includes one or more (such as 2, 3, 4, 5, 6, 7, 8, 9 or 10) residues substituted at any one of the positions listed in one or more of rows 1, 2, 3, 4, 5, 6, 7, 8, 9, 10 or 11 of column (ii) of Table 3, wherein the polypeptide does not exhibit an HCMV gB postfusion conformation. In an embodiment, the resulting polypeptide exhibits an HCMV gB prefusion conformation.

In some embodiments, the polypeptide includes one or more (such as 2, 3, 4, 5, 6, 7, 8, 9 or 10) residues substituted at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or 31 of column (ii) of Table 4, wherein the polypeptide does not exhibit an HCMV gB postfusion conformation. In an embodiment, the resulting polypeptide exhibits an HCMV gB prefusion conformation.

In some embodiments, the polypeptide includes a mutation at position 670 (listed in rows 1 and 2, column (ii) of Table 3) according to the numbering of SEQ ID NO: 1. In some embodiments, the polypeptide includes a mutation at position 673 (listed in rows 3 and 4, column (ii) of Table 3) according to the numbering of SEQ ID NO: 1. In some embodiments, the polypeptide includes a mutation at position 691 (listed in rows 5 and 6, column (ii) of Table 3) according to the numbering of SEQ ID NO: 1.

In some embodiments, the polypeptide includes a mutation at position 670 according to the numbering of SEQ ID NO: 1. In some embodiments, the polypeptide includes a mutation at position 682 according to the numbering of SEQ ID NO: 1. In some embodiments, the polypeptide includes a mutation at position 686 according to the numbering of SEQ ID NO: 1. In some embodiments, the polypeptide includes a mutation at position 118 according to the numbering of SEQ ID NO: 1. In some embodiments, the polypeptide includes a mutation at position 646 according to the numbering of SEQ ID NO: 1.

In further embodiments, the polypeptide includes an electrostatic mutation that is introduced by substitutions at any one of the positions listed in one or more of rows 1, 2, 3, 4, 5, 6, 7, 8, 9, 10 or 11 of column (iii) of Table 3, wherein the polypeptide does not exhibit an HCMV postfusion conformation.

In a preferred embodiment, the polypeptide includes a substitution K670L (listed in row 1, column (iii) of Table 3) according to the numbering of SEQ ID NO: 1. In another preferred embodiment, the polypeptide includes a substitution K670F (listed in row 2, column (iii) of Table 3) according to the numbering of SEQ ID NO: 1. In a further preferred embodiment, the polypeptide includes a substitution R673L (listed in row 3, column (iii) of Table 3) according to the numbering of SEQ ID NO: 1. In a preferred embodiment, the polypeptide includes a substitution R673F (listed in row 4, column (iii) of Table 3) according to the numbering of SEQ ID NO: 1. In another preferred embodiment, the polypeptide includes a substitution K691L (listed in row 5, column (iii) of) Table 3 according to the numbering of SEQ ID NO: 1. In a further preferred embodiment, the polypeptide includes a substitution K691F (listed in row 6, column (iii) of Table 3) according to the numbering of SEQ ID NO: 1. In a further preferred embodiment, the polypeptide includes a substitution K691F (listed in row 7, column (iii) of Table 3) according to the numbering of SEQ ID NO: 1. In a further preferred embodiment, the polypeptide includes a substitution K691F (listed in row 8, column (iii) of Table 3) according to the numbering of SEQ ID NO: 1. In a further preferred embodiment, the polypeptide includes a substitution K691F (listed in row 9, column (iii) of Table 3) according to the numbering of SEQ ID NO: 1. In a further preferred embodiment, the polypeptide includes a substitution K691F (listed in row 10, column (iii) of Table 3) according to the numbering of SEQ ID NO: 1. In a further preferred embodiment, the polypeptide includes a substitution K691F (listed in row 11, column (iii) of Table 3) according to the numbering of SEQ ID NO: 1.

In some embodiments, the polypeptide includes a combination of two or more of the phenylalanine (F) and leucine (L) substitutions listed in Table 3.

In a preferred embodiment, the polypeptide includes a substitution D679S according to the numbering of SEQ ID NO: 1. In another preferred embodiment, the polypeptide includes a substitution D679N according to the numbering of SEQ ID NO: 1. In another preferred embodiment, the polypeptide includes a substitution E682S according to the numbering of SEQ ID NO: 1. In another preferred embodiment, the polypeptide includes a substitution E682Q according to the numbering of SEQ ID NO: 1. In another preferred embodiment, the polypeptide includes a substitution E686S according to the numbering of SEQ ID NO: 1. In another preferred embodiment, the polypeptide includes a substitution E686Q according to the numbering of SEQ ID NO: 1. In another preferred embodiment, the polypeptide includes a substitution N118P according to the numbering of SEQ ID NO: 1. In another preferred embodiment, the polypeptide includes a substitution D646P according to the numbering of SEQ ID NO: 1.

In some embodiments, the polypeptide includes a combination of two or more of the phenylalanine (F) and leucine (L) substitutions listed in Table 3. In some embodiments, the polypeptide includes an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 38; SEQ ID NO: 39; SEQ ID NO: 40; SEQ ID NO: 41; SEQ ID NO: 42; and SEQ ID NO: 43.

In some embodiments, the polypeptide includes an amino acid sequence having at least 70%, 75%, 80%, 81%, 82%, 83%, 84%, 85%, 86%, 87%, 88%, 89%, 90%, 91%, 92%, 93%, 94%, 95%, 96%, 97%, 98%, 99%, or 100% identity to any sequence selected from: SEQ ID NO: 99; SEQ ID NO: 100, SEQ ID NO: 102, SEQ ID NO: 103, SEQ ID NO: 104, SEQ ID NO: 105, and SEQ ID NO: 106.

In additional embodiments, the polypeptide includes the amino acid sequence as set forth in any one of the SEQ ID NOs listed in column (iv) of Table 3. That is, an exemplary polypeptide includes a polypeptide having the amino acid sequence selected from any one of: SEQ ID NO: 38; SEQ ID NO: 39; SEQ ID NO: 40; SEQ ID NO: 41; SEQ ID NO: 42; and SEQ ID NO: 43. In some embodiments, the polypeptide has the amino acid sequence selected from any one of: SEQ ID NO: 99; SEQ ID NO: 100, SEQ ID NO: 102, SEQ ID NO: 103, SEQ ID NO: 104, SEQ ID NO: 105, and SEQ ID NO: 106.

In some embodiments, the polypeptide includes one or more (such as 2, 3, 4, 5, 6, 7, 8, 9 or 10) residues substituted at any one of the positions listed in one or more of rows 1, 2, 3, 4, 5, 6, 7, 8, 9, 10, 11, 12, 13, 14, 15, 16, 17, 18, 19, 20, 21, 22, 23, 24, 25, 26, 27, 28, 29, 30 or 31 of column (iii) of Table 4, wherein the polypeptide does not exhibit an HCMV gB postfusion conformation. In an embodiment, the resulting polypeptide exhibits an HCMV gB prefusion conformation.

In some embodiments, amino acids can be inserted (or deleted) from the native HCMV gB sequence to adjust the alignment of residues in the polypeptide structure, such that particular residue pairs are within a sufficiently close distance to form a desired electrostatic interaction in the prefusion, but not postfusion, conformation. In several such embodiments, the polypeptide includes a desired electrostatic interaction at any of the positions listed in one or more of rows 1, 2, 3, 4, 5, 6, 7, 8, 9, 10, or 11 of column (ii) of Table 3, wherein the polypeptide does not exhibit an HCMV postfusion conformation.

This invention provides a mutant of a wild-type cytomegalovirus (CMV) glycoprotein B (gB) protein, which mutant comprises at least two amino acid mutations relative to the amino acid sequence of the wild-type CMV gB protein, and wherein the amino acid mutation is selected from the group consisting of:

(1) an engineered disulfide bond mutation;

(2) an additional mutation; and (3) a combination of at least one engineered disulfide mutation and at least one additional mutation.

In one aspect, the amino acid mutations comprise a combination of at least two engineered disulfide mutations and at least one additional mutation. In another aspect, the mutant of a wild-type CMV gB protein is in the form of a trimer.

In another aspect, the mutant of a wild-type CMV gB protein has increased stability in prefusion form as compared with the corresponding wild-type CMV gB protein, wherein the stability is measured by binding of a prefusion-specific antibody, thermal shift assay or EM imaging.

In another aspect, the mutant of the wild-type CMV gB is Towne strain.

In another aspect of the invention, the engineered disulfide mutation is selected from the group consisting of: D217C and Y589C; M371C and W506C; and N524C and M684C.

In a further aspect of the invention, the additional mutation is selected from the group consisting of:
(1) substitution of YIH at positions 155-157 with GHR;
(2) substitution of W at position 240 with A;
(3) substitution of C at position 246 with S;
(4) substitution of P at position 655 with S;
(5) substitution of F at position 678 with S; and
(6) substitution of L at position 680 with T;
(7) substitution of R at position 685 with A;
(8) substitution of MIALDI at positions 648-653 with GSGKDG;
(9) substitution of R at position 693 with V;
(10) substitution of I at position 675 with S;
(11) substitution of I at positions 767 and 768 with C;
(12) substitution of D at position 703 and P at position 704 with C; and
(13) substitution of Y at position 696 and V at position 697 with C.

In another aspect of the invention, the additional mutation is selected from the group consisting of:
(1) substitution of YIH at positions 155-157 with GHR;
(2) substitution of W at position 240 with A;
(3) substitution of C at position 246 with S; and
(4) substitution of I at position 675 with S.

In another aspect of the invention, the amino acid mutation is a combination of at least two engineered disulfide mutations and at least one additional mutation, and wherein:
(i) the engineered disulfide mutations are selected from the group consisting of: D217C and Y589C; M371C and W506C; and N524C and M684C; and
(ii) the additional mutation is selected from the group consisting of:
(1) substitution of YIH at positions 155-157 with GHR;
(2) substitution of W at position 240 with A;
(3) substitution of C at position 246 with S;
(4) substitution of P at position 655 with S;
(5) substitution of F at position 678 with S; and
(6) substitution of L at position 680 with T;
(7) substitution of R at position 685 with A;
(8) substitution of MIALDI at positions 648-653 with GSGKDG;
(9) substitution of R at position 693 with V;
(10) substitution of I at position 675 with S;
(11) substitution of I at positions 767 and 768 with C;
(12) substitution of D at position 703 and P at position 704 with C; and
(13) substitution of Y at position 696 and V at position 697 with C.

In another aspect of the invention, the amino acid mutations are a combination of mutations selected from the group consisting of:
(1) combination of D217C and Y589C, M371C and W506C, and I675S;
(2) combination of D217C and Y589C, N524C and M684C, and I675S;
(3) combination of D217C and Y589C, M371C and W506C, Y155G I156H H157R, W240A, C246S and I675S; and
(4) combination of D217C and Y589C, N524C and M684C, Y155G I156H H157R, W240A, C246S and I675S.

In another aspect of the invention, the mutant comprises a cysteine (C) at position 217 (217C) and at position 589 (589C), a cysteine (C) at position 371 (371C) and at position 506 (506C), and a serine (S) at position 675 (675S), and wherein the mutant is selected from the group consisting of:
(1) a mutant comprising the amino acid sequence set forth in SEQ ID NO:257; and
(2) a mutant comprising an amino acid sequence that is at least 97%, 98% or 99% identical to the amino acid sequence of SEQ ID NO:257.

In another aspect of the invention, the mutant comprises a cysteine (C) at position 217 (217C) and at position 589 (589C), a cysteine (C) at position 524 (524C) and at position 684 (684C), and a serine (S) at position 675 (675S), and wherein the mutant is selected from the group consisting of:
(1) a mutant comprising the amino acid sequence of SEQ ID NO: 259; and
(2) a mutant comprising an amino acid sequence that is at least 97%, 98% or 99% identical to the amino acid sequence of SEQ ID NO: 259.

In another aspect of the invention, the mutant comprises a cysteine (C) at position 217 (217C) and at position 589 (589C), a cysteine (C) at position 371 (371C) and at position 506 (506C), a serine (S) at position 675 (675S), a glycine (G) at position 155 (155G), a histidine at position 156 (156H), an arginine at position 157 (157R), an alanine at position 240 (240A), and a serine at position 246 (246S), and wherein the mutant is selected from the group consisting of:
(1) a mutant comprising the amino acid sequence set forth in SEQ ID NO:261; and
(2) a mutant comprising an amino acid sequence that is at least 97%, 98% or 99% identical to the amino acid sequence of SEQ ID NO: 261; (1) a mutant comprising the amino acid sequence set forth in SEQ ID NO: 261;
(3) a mutant comprising the amino acid sequence set forth in SEQ ID NO: 265; and
(4) a mutant comprising an amino acid sequence that is at least 97%, 98% or 99% identical to the amino acid sequence of SEQ ID NO:265.

In another aspect of the invention, the mutant comprises a cysteine (C) at position 217 (217C) and at position 589 (589C), a cysteine (C) at position 524 (524C) and at position 684 (684C), a serine (S) at position 675 (675S), a glycine (G) at position 155 (155G), a histidine at position 156 (156H), an arginine at position 157 (157R), an alanine at position 240 (240A), and a serine at position 246 (246S), and wherein the mutant is selected from the group consisting of:
(1) a mutant comprising the amino acid sequence of SEQ ID NO: 263; and
(2) a mutant comprising an amino acid sequence that is at least 97%, 98% or 99% identical to the amino acid sequence of SEQ ID NO:263.

In another aspect of the invention, the amino acid sequence of the wildtype CMV gB polypeptide is set forth in SEQ ID NO: 1.

In another aspect of the invention, the amino acid sequence of the mutant does not comprise a signal sequence. In another aspect of the invention, the mutant comprises residues 23-907 of SEQ ID NO: 1.

In another aspect of the invention, the amino acid sequence of the mutant does not comprise an MPR, TM or CT domain. In another aspect of the invention, the mutant comprises residues 23-707 of SEQ ID NO: 1.

In another aspect of the invention, the amino acid sequence of the mutant comprises a truncated Domain V region. In another aspect of the invention, the mutant comprises residues 23-702 or 23-703 of SEQ ID NO: 1.

In another aspect of the invention, the amino acid sequence of the mutant does not comprise a Domain V region. In another aspect of the invention, the mutant comprises residues 23-646 of SEQ ID NO: 1.

In another aspect of the invention, the mutant further comprises a trimerization motif linked to the C terminus of the mutant. In another aspect of the invention, the trimerization motif is selected from the group consisting of:
 (i) an inter-protomer disulfide ring;
 (ii) GCN4;
 (iii) T4 fibritin foldon; and
 (iv) C-terminus fusion sequence.
In another aspect of the invention,
 (i) the GCN4 comprises an amino acid sequence as set forth in SEQ ID NOs: 269, 272 or 273;
 (ii) the T4 fibritin foldon comprises an amino acid sequence as set forth in SEQ ID NO: 271; or
 (iii) the C-terminus fusion sequence comprises an amino acid sequence as set forth in SEQ ID NO: 274.

In another aspect of the invention, the inter-protomer disulfide ring comprises at least two engineered cysteine mutations selected from:
 (i) 696C and 697C;
 (ii) 703C and 704C; or
 (iii) 767C and 768C.

Several exogenous multimerization domains that promote formation of stable trimers of soluble proteins are known in the art. Examples of such multimerization domains that can be linked to a mutant provided by the present disclosure include, but are not limited to: (1) the GCN4 leucine zipper (Harbury et al. 1993 Science 262: 1401-1407); (2) the trimerization motif from the lung surfactant protein (Hoppe et al. 1994 FEB S Lett 344: 191-195); (3) collagen (McAlinden et al. 2003 Biol Chem 278:42200-42207); and (4) the phage T4 fibritin foldon (Miroshnikov et al. 1998 Protein Eng 11:329-414). In some embodiments, a multimerization domain is linked to a CMV gB mutant at the C-terminus. In specific embodiments, the trimerization domain is set forth in SEQ ID NOs: 269-274. Methods for connecting the multimerization domain to the gB polypeptide are well known in the art.

As used herein, "inter-protomer disulfide ring" shall mean a covalent ring formation between three helices achieved by three interhelical disulfide bonds formed by a ring system comprising pairs of adjacent cysteine residues, which establishes a functional topology and stabilization of the multimer (e.g. trimer). See, Stewart-Jones G B E, et al. (2015) A Cysteine Zipper Stabilizes a Pre-Fusion F Glycoprotein Vaccine for Respiratory Syncytial Virus. PLoS ONE 10(6): e0128779. doi:10.1371/journal.pone.0128779.

In another aspect of the invention, the mutant is secreted. In another aspect of the invention, the mutant is soluble.

In another aspect of the invention, the wildtype CMV gB polypeptide sequence is selected from SEQ ID NOs: 107-140 or 224.

In another aspect of the invention, the wildtype CMV gB polypeptide sequence is encoded by the polynucleotide sequences set forth in SEQ ID NOs: 225-254.

This invention also provides a nucleic acid molecule comprising nucleotides that encode an amino acid sequence of a CMV gB protein mutant according to the embodiment and aspects described herein.

In one aspect, the nucleic acid comprises nucleotides having a sequence set forth in SEQ ID NOs: 225-254.

This invention also provides a pharmaceutical composition comprising (i) a CMV gB protein mutant according to the embodiments and aspects described herein and (ii) a pharmaceutically acceptable carrier.

In one aspect, the pharmaceutical composition is a vaccine.

This invention also provides a method of reducing CMV infection in a subject comprising administering to the subject an effective amount of the vaccine set forth in the embodiments herein.

This invention also provides a method of eliciting an immune response to CMV infection in a subject comprising administering to the subject an effective amount of the vaccine set forth in the embodiments herein.

This invention also provides a method of preventing CMV infection in a subject comprising administering to the subject an effective amount of the vaccine set forth in the embodiments herein.

In one aspect, the subject is a human.

2. Further Embodiments of the Polypeptide

In some embodiments, the polypeptide does not include a mutation at any one of the following amino acid positions: 280, 281, 283, 284, 285, 286, 290, 292, 295, 297, 298, 299, or any combinations thereof, according to the numbering of reference sequence SEQ ID NO: 46. In some exemplary embodiments, the polypeptide does not include a substitution of any one of the following residues, according to the numbering of reference sequence SEQ ID NO: 46: Y280; N281; T283; N284; R285; N286; F290; E292; N293; F297; F298; I299; F298; and any combinations thereof. Without being bound by theory or mechanism, residues important for neutralizing antibodies may include Y280/N284 and Y280/N293/D295. Accordingly, in a preferred embodiment, the polypeptide does not include mutations at Y280, N293, N284, and D295, as compared to reference sequence SEQ ID NO: 46.

In some embodiments, the polypeptide does not include a mutation at any one of the following amino acid positions: R562, P577, S587, Y588, G592, G595, L601/H605, C610, L612, P613, Y625, Y627, F632, and K633, and any combinations thereof, according to the numbering of reference sequence SEQ ID NO: 44. In some embodiments, the polypeptide does not include any one of the following amino acid mutations: R562C, P577L, S587L, Y588C, G592S, G595D, L601P/H605N, C610Y, L612F, P613Y, Y625C, Y627C, F632L, and K633T, or any combinations thereof, according to the numbering of reference sequence SEQ ID NO: 44. Without being bound by theory or mechanism, P577 and Y627 are believed to be located next to each other within the domain IV core while C610 participates in a conserved disulfide bond. Thus, all three residues may help maintain the position of domain IV in the prefusion structure and, therefore, the stability of entire antigenic site AD-1. Moreover, without being bound by theory or mechanism, F632 and G595 are believed to be exposed on the surface of the prefusion form of gB. Accordingly, in a preferred embodiment, the polypeptide does not include a mutation at P577, Y627, C610, F632, and G595, or any combinations thereof, according to the numbering of reference sequence SEQ ID NO: 44.

3. Cavity Filling Mutations

In still other embodiments, the polypeptide includes amino acid mutations that are one or more cavity filling mutations. Examples of amino acids that may be replaced with the goal of cavity filling include small aliphatic (e.g. Gly, Ala, and Val) or small polar amino acids (e.g. Ser and Thr) and amino acids that are buried in the pre-fusion conformation, but exposed to solvent in the post-fusion conformation. Examples of the replacement amino acids include large aliphatic amino acids (Ile, Leu and Met) or large aromatic amino acids (His, Phe, Tyr and Trp).

4. Combination of Mutations

In another aspect, the present invention relates to a polypeptide that includes a combination of two or more different types of mutations selected from at least two engineered disulfide bond mutations, and at least one additional mutation such as a cavity filling mutation, an electrostatic mutation, an inter-protomer disulfide ring each as described herein. In some embodiments, the polypeptide includes at least two disulfide bond mutations and at least one electrostatic mutation. More specifically, in some embodiments, the polypeptide includes at least two cysteine substitutions and at least one phenylalanine substitution. In some embodiments, the polypeptide includes at least two cysteine substitutions and at least one leucine substitution.

In some further embodiments, the polypeptide includes at least two mutations selected from any one of the mutations in Table 2 and at least one mutation selected from any one of the mutations in Table 3. In some further embodiments, the polypeptide includes at least two mutations selected from any one of the mutations in Table 2 and at least one mutation selected from any one of the mutations in Table 4. In some further embodiments, the polypeptide includes at least two mutations selected from any one of the mutations in Table 2, at least one mutation selected from any one of the mutations in Table 3 and at least one mutation selected from any one of the mutations in Table 4.

Preparation of the Polypeptide

The polypeptides described herein may be prepared by routine methods known in the art, such as by expression in a recombinant host system using a suitable vector. Suitable recombinant host cells include, for example, insect cells, mammalian cells, avian cells, bacteria, and yeast cells. Examples of suitable insect cells include, for example, Sf9 cells, Sf21 cells, Tn5 cells, Schneider S2 cells, and HIGH FIVE cells (a clonal isolate derived from the parental *Trichoplusia ni* BTI-TN-5B1-4 cell line). Examples of suitable mammalian cells include Chinese hamster ovary (CHO) cells, human embryonic kidney cells (HEK293 or Expi 293 cells, typically transformed by sheared adenovirus type 5 DNA), NIH-3T3 cells, 293-T cells, Vero cells, and HeLa cells. Suitable avian cells include, for example, chicken embryonic stem cells (e.g., EBx® cells), chicken embryonic fibroblasts, chicken embryonic germ cells, quail fibroblasts (e.g. ELL-O), and duck cells. Suitable insect cell expression systems, such as baculovirus-vectored systems, are known to those of skill in the art. Materials and methods for baculovirus/insect cell expression systems are commercially available in kit form from. Avian cell expression systems are also known to those of skill in the art. Similarly, bacterial and mammalian cell expression systems are also known in the art.

A number of suitable vectors for expression of recombinant proteins in insect or mammalian cells are well-known and conventional in the art. Suitable vectors can contain a number of components, including, but not limited to one or more of the following: an origin of replication; a selectable marker gene; one or more expression control elements, such as a transcriptional control element (e.g., a promoter, an enhancer, a terminator), and/or one or more translation signals; and a signal sequence or leader sequence for targeting to the secretory pathway in a selected host cell (e.g., of mammalian origin or from a heterologous mammalian or non-mammalian species). For example, for expression in insect cells a suitable baculovirus expression vector, such as PFASTBAC, is used to produce recombinant baculovirus particles. The baculovirus particles are amplified and used to infect insect cells to express recombinant protein. For expression in mammalian cells, a vector that will drive expression of the construct in the desired mammalian host cell (e.g., Chinese hamster ovary cells) is used.

The polypeptide can be purified using any suitable methods. For example, methods for purifying a polypeptide by immunoaffinity chromatography are known in the art. Suitable methods for purifying desired polypeptides including precipitation and various types of chromatography, such as hydrophobic interaction, ion exchange, affinity, chelating and size exclusion are known in the art. Suitable purification schemes can be created using two or more of these or other suitable methods. If desired, the polypeptide may include a "tag" that facilitates purification, such as an epitope tag or a histidine tag. Such tagged polypeptides can be purified, for example from conditioned media, by chelating chromatography or affinity chromatography.

Nucleic Acids Encoding Polypeptides

In another aspect, the invention relates to nucleic acid molecules that encode a polypeptide described herein. These nucleic acid molecules include DNA, cDNA, and RNA sequences. Nucleic acid molecules that encode only the ectodomain of the polypeptide are also encompassed by the invention. The nucleic acid molecule can be incorporated into a vector, such as an expression vector.

In some embodiments, the nucleic acid includes a self-replicating RNA molecule. In some embodiments, the nucleic acid includes a modified RNA molecule. In another aspect, the invention relates to a composition including a nucleic acid according to any one of the embodiments described herein.

Compound-Stabilized Polypeptide

The inventors discovered a polypeptide stabilized in a prefusion conformation that can be identified by, for example, the binding of a bis(aryl)thiourea compound to an HCMV gB. Bis(aryl)thiourea compounds, as exemplified by structures 1a,b (Formula I), are highly potent and specific inhibitors of CMV. In one aspect, the invention relates to a polypeptide that is capable of binding to a bis(aryl)thiourea compound. In preferred embodiments, the compound does not bind to a postfusion conformation of the HCMV gB polypeptide.

(Formula I)

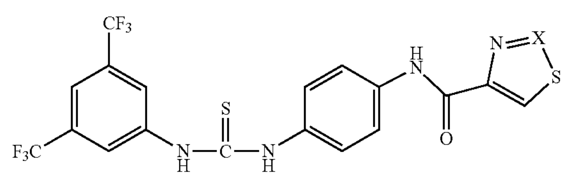

1a (X = CH)
1b (X = N)

In a preferred embodiment, the compound is a bis(aryl) thiourea thioziole analog thereof. Most preferably, in some embodiments, the compound is N-{4-[({(1S)-1-[3,5-bis(trifluoromethyl)phenyl]ethyl}carbamothioyl)amino]phenyl}-1,3-thiazole-4-carboxamide, having the following structure:

In another embodiment, the compound has the following structure:

In several embodiments, the polypeptide includes an HCMV gB prefusion epitope, which is not present in a native HCMV gB a postfusion conformation.

In some embodiments, at least about 90% of the polypeptides (such as at least about 91%, 92%, 93%, 94%, 95%, 96%, 97%, 98%, 99% or 99.9% of the polypeptides in the homogeneous population are bound by a bis(aryl)thiourea compound (e.g., such as a thiazole analog of bis(aryl) thiourea compounds, more preferably N-{4-[({(1S)-1-[3,5-bis(trifluoromethyl)phenyl]ethyl}carbamothioyl) amino] phenyl}-1,3-thiazole-4-carboxamide).

In some embodiments, the polypeptide that can bind to the bis(aryl)thiourea compound does not have a postfusion conformation. Rather, the polypeptide has a prefusion conformation, such as an HCMV gB prefusion conformation.

In another embodiment, the polypeptide can be at least 80% isolated, at least 90%, 95%, 98%, 99%, or preferably 99.9% isolated from HCMV gB polypeptides that are not specifically bound by a bis(aryl)thiourea compound.

Compositions Including a Polypeptide and Methods of Use Thereof

The invention relates to compositions and methods of using the polypeptide described herein, or a nucleic acid encoding such polypeptide described herein. For example, the polypeptide of the invention can be delivered directly as a component of an immunogenic composition. Alternatively, nucleic acids that encode the polypeptide of the invention can be administered to produce the polypeptide or immunogenic fragment in vivo. Certain preferred embodiments, such as protein formulations, recombinant nucleic acids (e.g., DNA, RNA, self-replicating RNA, or any variation thereof) and viral vectors (e.g., live, single-round, non-replicative assembled virions, or otherwise virus-like particles, or alphavirus VRP) that contain sequences encoding polypeptides are further described herein and may be included in the composition.

In one aspect, the invention provides an immunogenic composition comprising the polypeptide described herein. The immunogenic composition can include additional CMV proteins, such as gO, gH, gL, pUL128, pUL130, pUL131, pp65, an immunogenic fragment thereof, or a combination thereof. For example, the polypeptide can be combined with CMV pentameric complex comprising: gH or a pentamer-forming fragment thereof, gL or a pentamer-forming fragment thereof, pUL128 or a pentamer-forming fragment thereof, pUL130 or a pentamer-forming fragment thereof, and pUL131 or a pentamer-forming fragment thereof. The polypeptide of the invention can also be combined with CMV trimeric complex comprising: gH or a trimer-forming fragment thereof, gL or a trimer-forming fragment thereof, and gO or a trimer-forming fragment thereof.

In another aspect, the invention relates to a composition including a polynucleotide that may elicit an immune response in a mammal. The polynucleotide encodes at least one polypeptide of interest, e.g., an antigen. Antigens disclosed herein may be wild type (i.e., derived from the infectious agent) or preferably modified (e.g., engineered, designed or artificial). The nucleic acid molecules described herein, specifically polynucleotides, in some embodiments, encode one or more peptides or polypeptides of interest. Such peptides or polypeptides may serve as an antigen or antigenic molecule. The term "nucleic acid" includes any compound that includes a polymer of nucleotides. These polymers are referred to as "polynucleotides." Exemplary nucleic acids or polynucleotides of the invention include, but are not limited to, ribonucleic acids (RNAs), including mRNA, and deoxyribonucleic acids (DNAs).

In some embodiments, the composition includes DNA encoding a polypeptide or fragment thereof described herein. In some embodiments, the composition includes RNA encoding a polypeptide or fragment thereof described herein. In some embodiments, the composition includes an mRNA polynucleotide encoding a polypeptide or fragment thereof described herein. Such compositions may produce the appropriate protein conformation upon translation.

In one aspect, the invention relates to a composition that includes at least one polynucleotide encoding a polypeptide including at least one amino acid mutation relative to the amino acid sequence of the wild-type HCMV gB.

In one aspect, the invention relates to a composition that includes at least one DNA polynucleotide encoding a polypeptide including at least one amino acid mutation relative to the amino acid sequence of the wild-type HCMV gB.

In one aspect, the invention relates to a composition that includes at least one RNA polynucleotide encoding a polypeptide including at least one amino acid mutation relative to the amino acid sequence of the wild-type HCMV gB.

In some embodiments, the invention relates to a composition that includes at least one polynucleotide encoding at least one hCMV gB polypeptide or an immunogenic fragment or epitope thereof.

In some embodiments, the composition includes at least one polynucleotide encoding two or more antigenic polypeptides or an immunogenic fragment or epitope thereof. In some embodiments, the composition includes two or more polynucleotides encoding two or more antigenic polypeptides or immunogenic fragments or epitopes thereof. The one or more antigenic polypeptides may be encoded on a single polynucleotide or may be encoded individually on multiple (e.g., two or more) polynucleotides.

In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide.

In another aspect, the invention relates to a composition that includes (a) a polynucleotide encoding a polypeptide including at least one introduced amino acid mutation relative to the amino acid sequence of the wild-type HCMV glycoprotein B (gB); and (b) a polynucleotide encoding an additional polypeptide, preferably an HCMV antigenic polypeptide. The additional polypeptide may be selected from HCMV gH, gL, gB, gO, gN, and gM and an immunogenic fragment or epitope thereof. In some embodiments, the additional polypeptide is HCMV pp65. In some embodiments, the additional polypeptide may be selected from gH, gL, gO, gM, gN, UL128, UL130, and UL131A, and fragments thereof. In some embodiments, the additional polypeptide is HCMV gH polypeptide. In some embodiments, the additional polypeptide is an HCMV gL polypeptide. In some embodiments, the additional polypeptide is an HCMV gB polypeptide. In some embodiments, the additional polypeptide is an HCMV gO polypeptide. In some embodiments, the additional polypeptide is an HCMV gN polypeptide. In some embodiments, the additional polypeptide is an HCMV gM polypeptide. In some embodiments, the additional polypeptide is a variant gH polypeptide, a variant gL polypeptide, or a variant gB polypeptide. In some embodiments, the variant HCMV gH, gL, or gB polypeptide is a truncated polypeptide lacking one or more of the following domain sequences: (1) the hydrophobic membrane proximal domain, (2) the transmembrane domain, and (3) the cytoplasmic domain. In some embodiments, the truncated HCMV gH, gL, or gB polypeptide lacks the hydrophobic membrane proximal domain, the transmembrane domain, and the cytoplasmic domain. In some embodiments, the truncated HCMV gH, gL, or gB polypeptide includes only the ectodomain sequence. In some embodiments, an antigenic polypeptide is an HCMV protein selected from UL83, UL123, UL128, UL130 and UL131A or an immunogenic fragment or epitope thereof. In some embodiments, the antigenic polypeptide is an HCMV UL83 polypeptide. In some embodiments, the antigenic polypeptide is an HCMV UL123 polypeptide. In some embodiments, the antigenic polypeptide is an HCMV UL128 polypeptide. In some embodiments, the antigenic polypeptide is an HCMV UL130 polypeptide. In some embodiments, the antigenic polypeptide is an HCMV UL131 polypeptide.

In another aspect, the invention relates to a composition that includes (a) a polynucleotide encoding a polypeptide including at least two introduced amino acid mutations relative to the amino acid sequence of the wild-type HCMV glycoprotein B (gB); and (b) a polynucleotide encoding an additional polypeptide having any one of the amino acid sequences set forth in SEQ ID NOs: 211-223. In another aspect, the invention relates to a composition that includes (a) a polynucleotide encoding a polypeptide including at least two introduced amino acid mutations relative to the amino acid sequence of the wild-type HCMV glycoprotein B (gB); and (b) a polynucleotide having any one of the sequences selected from SEQ ID NOs: 141-210. In another aspect, the invention relates to a composition that includes (a) a polynucleotide encoding a polypeptide including at least two introduced amino acid mutations relative to the amino acid sequence of the wild-type HCMV glycoprotein B (gB); and (b) an additional polypeptide having any one of the amino acid sequences selected from SEQ ID NOs: 211-223. In some embodiments, the polynucleotide encoding the additional polypeptide includes at least one nucleic acid sequence selected from any of SEQ ID NOs: 225-254. In some embodiments, the polynucleotide encoding the additional polypeptide includes at least one nucleic acid sequence selected from any of SEQ ID NOs: 141-147. In some embodiments, the polynucleotide encoding the additional polypeptide has at least one sequence selected from any of SEQ ID NOs: 220-223.

In some embodiments, the antigenic polypeptide includes two or more HCMV proteins, fragments, or epitopes thereof. In some embodiments, the antigenic polypeptide includes two or more glycoproteins, fragments, or epitopes thereof. In some embodiments, the antigenic polypeptide includes at least one HCMV polypeptide, fragment or epitope thereof and at least one other HCMV protein, fragment or epitope thereof. In some embodiments, the two or more HCMV polypeptides are encoded by a single RNA polynucleotide. In some embodiments, the two or more HCMV polypeptides are encoded by two or more RNA polynucleotides, for example, each HCMV polypeptide is encoded by a separate RNA polynucleotide. In some embodiments, the two or more HCMV polypeptides can be any combination of HCMV gH, gL, gB, gO, gN, and gM polypeptides or immunogenic fragments or epitopes thereof. In some embodiments, the two or more glycoproteins includes pp65 or immunogenic fragments or epitopes thereof; and any combination of HCMV gH, gL, gB, gO, gN, and gM polypeptides or immunogenic fragments or epitopes thereof. In some embodiments, the two or more glycoproteins can be any combination of HCMV gB and one or more HCMV polypeptides selected from gH, gL, gO, gN, and gM polypeptides or immunogenic fragments or epitopes thereof. In some embodiments, the two or more glycoproteins can be any combination of HCMV gH and one or more HCMV polypeptides selected from gL, gO, gN, and gM polypeptides or immunogenic fragments or epitopes thereof. In some embodiments, the two or more glycoproteins can be any combination of HCMV gL and one or more HCMV polypeptides selected from gB, gH, gO, gN, and gM polypeptides or immunogenic fragments or epitopes thereof. In some embodiments, the two or more HCMV polypeptides are gB and gH. In some embodiments, the two or more HCMV polypeptides are gB and gL. In some embodiments, the two or more HCMV polypeptides are gH and gL. In some embodiments, the two or more HCMV polypeptides are gB, gL, and gH. In some embodiments, the two or more HCMV proteins can be any combination of HCMV UL83, UL123, UL128, UL130, and UL131A polypeptides or immunogenic fragments or epitopes thereof. In some embodiments, the two or more HCMV polypeptides are UL123 and UL130. In some embodiments, the two or more HCMV polypeptides are UL123 and 131 A. In some embodiments, the two or more HCMV polypeptides are UL130 and 131 A. In some embodiments, the two or more HCMV polypeptides are UL 128, UL130 and 131 A. In some embodiments, the two or more HCMV proteins can be any combination of HCMV gB, gH, gL, gO, gM, gN, UL83, UL123, UL128, UL130, and UL131A polypeptides or immunogenic fragments or epitopes thereof. In some embodiments, the two or more glycoproteins can be any combination of HCMV gH and one or more HCMV polypeptides selected from gL, UL128, UL130, and UL131A polypeptides or immunogenic fragments or epitopes thereof.

In some embodiments, the two or more glycoproteins can be any combination of HCMV gL and one or more HCMV polypeptides selected from gH, UL128, UL130, and UL131A polypeptides or immunogenic fragments or epitopes thereof. In some embodiments, the two or more HCMV polypeptides are gL, gH, UL 128, UL130 and 131 A. In any of these embodiments in which the composition includes two or more HCMV proteins, the HCMV gH may be a variant gH, such as any of the variant HCMV gH glycoproteins disclosed herein, for example, any of the variant HCMV gH disclosed herein. In any of these embodiments in which the composition includes two or more HCMV proteins, the HCMV gB may be a variant gB, such as any of the variant HCMV gB glycoproteins disclosed herein, for example, any of the variant HCMV gB disclosed herein. In any of these embodiments in which the composition includes two or more HCMV gL proteins, the HCMV gL may be a variant gL, such as any of the variant HCMV gL glycoproteins disclosed herein, for example, any of the variant HCMV gL disclosed herein.

In certain embodiments in which the composition includes two or more RNA polynucleotides encoding two or more HCMV antigenic polypeptides or an immunogenic fragment or epitope thereof (either encoded by a single RNA polynucleotide or encoded by two or more RNA polynucleotides, for example, each protein encoded by a separate RNA polynucleotide), the two or more HCMV proteins are a variant gB, for example, any of the variant gB polypeptides disclosed herein, and an HCMV protein selected from gH, gL, gO, gM, gN, UL128, UL130, and UL131 polypeptides or immunogenic fragments or epitopes thereof. In some embodiments, the two or more HCMV proteins are a variant gH, for example, any of the variant gH polypeptides disclosed herein, and an HCMV protein selected from gH, gL, gO, gM, gN, UL128, UL130, and UL131A polypeptides or immunogenic fragments or epitopes thereof. In some embodiments, the two or more HCMV proteins are a variant gH, for example, any of the variant gH polypeptides disclosed herein, and an HCMV protein selected from gH, gL, gO, gM, gN, UL128, UL130, and UL131 polypeptides or immunogenic fragments or epitopes thereof. In some embodiments in which the variant HCMV proteins are variant HCMV gB, variant HCMV gL, and variant HCMV gH, the variant HCMV polypeptide is a truncated polypeptide selected from the following truncated polypeptides: lacks the hydrophobic membrane proximal domain; lacks the transmembrane domain; lacks the cytoplasmic domain; lacks two or more of the hydrophobic membrane proximal, transmembrane, and cytoplasmic domains; and includes only the ectodomain. In some embodiments, the composition includes multimeric RNA polynucleotides encoding at least one HCMV antigenic polypeptide or an immunogenic fragment or epitope thereof. In some embodiments, the composition includes at least one RNA polynucleotide encoding at least one HCMV antigenic polypeptide or an immunogenic fragment or epitope thereof, wherein the 5'UTR of the RNA polynucleotide includes a patterned UTR. In some embodiments, the patterned UTR has a repeating or alternating pattern, such as ABABAB or AABBAABBAABB or ABCABCABC or variants thereof repeated once, twice, or more than 3 times. In these patterns, each letter, A, B, or C represent a different UTR at the nucleotide level. In some embodiments, the 5' UTR of the RNA polynucleotide (e.g., a first nucleic acid) has regions of complementarity with a UTR of another RNA polynucleotide (a second nucleic acid). For example, UTR nucleotide sequences of two polynucleotides sought to be joined (e.g., in a multimeric molecule) can be modified to include a region of complementarity such that the two UTRs hybridize to form a multimeric molecule. In some embodiments, the 5' UTR of an RNA polynucleotide encoding an HCMV antigenic polypeptide is modified to allow the formation of a multimeric sequence. In some embodiments, the 5' UTR of an RNA polynucleotide encoding an HCMV protein selected from UL128, UL130, UL131 is modified to allow the formation of a multimeric sequence. In some embodiments, the 5' UTR of an RNA polynucleotide encoding an HCMV polypeptide is modified to allow the formation of a multimeric sequence. In some embodiments, the 5' UTR of an RNA polynucleotide encoding an HCMV polypeptide selected from gH, gL, gB, gO, gM, and gN is modified to allow the formation of a multimeric sequence. In any of these embodiments, the multimer may be a dimer, a trimer, pentamer, hexamer, heptamer, octamer nonamer, or decamer. Thus, in some embodiments, the 5' UTR of an RNA polynucleotide encoding an HCMV protein selected from gH, gL, gB, gO, gM, gN, UL128, UL130, and UL131 is modified to allow the formation of a dimer. In some embodiments, the 5' UTR of an RNA polynucleotide encoding an HCMV protein selected from gH, gL, gB, gO, gM, gN, UL128, UL130, and UL131A is modified to allow the formation of a trimer. In some embodiments, the 5' UTR of an RNA polynucleotide encoding an HCMV protein selected from gH, gL, gB, gO, gM, gN, UL128, UL130, and UL131 is modified to allow the formation of a pentamer. In some embodiments, the composition includes at least one RNA polynucleotide having a single open reading frame encoding two or more (for example, two, three, four, five, or more) HCMV antigenic polypeptides or an immunogenic fragment or epitope thereof. In some embodiments, the composition includes at least one RNA polynucleotide having more than one open reading frame, for example, two, three, four, five or more open reading frames encoding two, three, four, five or more HCMV antigenic polypeptides. In either of these embodiments, the at least one RNA polynucleotide may encode two or more HCMV antigenic polypeptides selected from gH, gB, gL, gO, gM, gN, UL83, UL123, UL128, UL130, UL131A, and fragments or epitopes thereof. In some embodiments, the at least one RNA polynucleotide encodes UL83 and UL123. In some embodiments, the at least one RNA polynucleotide encodes gH and gL. In some embodiments, the at least one RNA polynucleotide encodes UL128, UL130, and UL131. In some embodiments, the at least one RNA polynucleotide encodes gH, gL, UL128, UL130, and UL131. In some embodiments, in which the at least one RNA polynucleotide has a single open reading frame encoding two or more (for example, two, three, four, five, or more) HCMV antigenic polypeptides, the RNA polynucleotide further comprises additional sequence, for example, a linker sequence or a sequence that aids in the processing of the HCMV RNA transcripts or polypeptides, for example a cleavage site sequence. In some embodiments, the additional sequence may be a protease sequence, such as a furin sequence. In some embodiments, the additional sequence may be self-cleaving 2A peptide, such as a P2A, E2A, F2A, and T2A sequence. In some embodiments, the linker sequences and cleavage site sequences are interspersed between the sequences encoding HCMV polypeptides.

In some embodiments, at least one RNA polynucleotide includes any nucleic acid sequence selected from any one of nucleic acid sequences disclosed herein, or homologs thereof having at least 80% (e.g., 85%, 90%, 95%, 98%, 99%) identity with a nucleic acid sequence disclosed herein.

In some embodiments, the open reading frame is encoded is codon-optimized. Some embodiments include a composition that includes at least one RNA polynucleotide encoding at least one HCMV antigenic polypeptide or an immunogenic fragment thereof and at least one 5' terminal cap. In some embodiments, a 5' terminal cap is 7mG(5')ppp(5') NlmpNp.

In some embodiments, the at least one polynucleotide includes a nucleic acid sequence selected from any one of SEQ ID NOs: 141-210. In some embodiments, the at least one polynucleotide encodes a polypeptide having at least 90% identity to any one of the amino acid sequences of SEQ ID NOs: 211-223. In some preferred embodiments, the composition does not include a polypeptide having the amino acid sequence SEQ ID NO: 216. In some preferred embodiments, the composition does not include a polynucleotide encoding the amino acid sequence SEQ ID NO: 216. In some preferred embodiments, the composition does not include a polynucleotide having the sequence SEQ ID NO: 152.

In some embodiments, the composition includes at least one polynucleotide, wherein the at least one polynucleotide has at least one chemical modification. In some embodiments, the at least one polynucleotide further includes a second chemical modification. Preferably, the polynucleotide is RAN. In some embodiments, the at least one polynucleotide having at least one chemical modification has a 5' terminal cap. In some embodiments, the at least one chemical modification is selected from pseudouridine, N1-methylpseudouridine, N1-ethylpseudouridine, N1-ethylpseudouridine, 2-thiouridine, 4'-thiouridine, 5-methylcytosine, 2-thio-I-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine. In some embodiments, the composition includes at least one polynucleotide, wherein at least 80% (e.g., 85%, 90%, 95%, 98%, 99%, 100%) of the uracil in the open reading frame has a chemical modification, optionally wherein the composition is formulated in a lipid nanoparticle. In some embodiments, 100% of the uracil in the open reading frame has a chemical modification. In some embodiments, a chemical modification is in the 5-position of the uracil. In some embodiments, a chemical modification is a N1-methyl pseudouridine.

In some embodiments, the additional polypeptides or immunogenic fragments encoded by the polynucleotide (e.g., in an mRNA composition) are selected from gB, gH, gL, gO, gM, gN, UL83, UL123, UL128, UL130, UL131A, pp65 and I E1 antigens.

In some embodiments, a first composition and a second composition are administered to the mammal. In some embodiments, a first composition includes a polynucleotide encoding a polypeptide including at least one introduced amino acid mutation relative to the amino acid sequence of the wild-type HCMV gB; and a second composition includes a polynucleotide encoding HCMV pp65 or an antigenic fragment or epitope thereof. In some embodiments, a first composition includes a polynucleotide encoding a polypeptide including at least one introduced amino acid mutation relative to the amino acid sequence of the wild-type HCMV gB; and a second composition includes a polynucleotide encoding at least one polynucleotide encoding an additional polypeptide selected from HCMV gH, gL, UL128, UL130, and UL131, or antigenic fragments or epitopes thereof.

In another aspect, the invention relates to methods of inducing an immune response in a mammal, including administering to the mammal a composition in an amount effective to induce an immune response, wherein the composition includes a polynucleotide encoding a polypeptide including at least two introduced amino acid mutations relative to the amino acid sequence of the wild-type HCMV gB.

In some embodiments, the immune response includes a T cell response or a B cell response. In some embodiments, the immune response includes a T cell response and a B cell response. In some embodiments, the method involves a single administration of the composition. In some embodiments, a method further includes administering to the subject a booster dose of the composition. The composition including a polynucleotide disclosed herein may be formulated in an effective amount to produce an antigen specific immune response in a mammal.

The immunogenic composition may include an adjuvant. Exemplary adjuvants to enhance effectiveness of the composition include: (1) aluminum salts (alum), such as aluminum hydroxide, aluminum phosphate, aluminum sulfate, etc.; (2) oil-in-water emulsion formulations (with or without other specific adjuvants such as muramyl peptides (see below) or bacterial cell wall components), such as for example (a) MF59 (PCT Publ. No. WO 90/14837), containing 5% Squalene, 0.5% TWEEN 80, and 0.5% Span 85 formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) RIBI™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (DETOX™); (3) saponin adjuvants, such as QS-21, STIMULON™ (Cambridge Bioscience, Worcester, Mass.), which may be used or particles generated therefrom such as ISCOMs (immunostimulating complexes); (4) Complete Freunds Adjuvant (CFA) and Incomplete Freunds Adjuvant (IFA); (5) cytokines, such as interleukins (IL-1, IL-2, etc.), macrophage colony stimulating factor (M-CSF), tumor necrosis factor (TNF), etc.; and (6) other substances that act as adjuvants to enhance the effectiveness of the composition. In a preferred embodiment, the adjuvant is a saponin adjuvant, namely QS-21. In some embodiments, the composition does not include an adjuvant. In some embodiments, the composition further includes a lipid nanoparticle. In some embodiments, the composition is formulated in a nanoparticle. In some embodiments, the composition further includes a cationic or polycationic compounds, including protamine or other cationic peptides or proteins, such as poly-L-lysine (PLL).

Each of the immunogenic compositions discussed herein may be used alone or in combination with one or more other antigens, the latter either from the same viral pathogen or from another pathogenic source or sources. These compositions may be used for prophylactic (to prevent infection) or therapeutic (to treat disease after infection) purposes.

In one embodiment, the composition may include a "pharmaceutically acceptable carrier," which includes any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as adjuvants. Furthermore, the antigen may be conjugated to a bacterial toxoid, such as a toxoid from diphtheria, tetanus, cholera, *H. pylori*, and etc. pathogens.

In one embodiment, the composition includes a diluent, such as water, saline, glycerol, ethanol, etc. Additionally, auxiliary substances, such as wetting or emulsifying agents, pH buffering substances, and the like, may be present in such vehicles.

The compositions described herein may include an immunologically effective amount of the polypeptide or polynucleotide, as well as any other of the above-mentioned components, as needed. By "immunologically effective amount," it is meant that the administration of that amount to an individual, either in a single dose or as part of a series, is effective for eliciting an immune response. The immune response elicited may be sufficient, for example, for treatment and/or prevention and/or reduction in incidence of illness, infection or disease. This amount varies depending upon the health and physical condition of the individual to be treated, the taxonomic group of individual to be treated (e.g., nonhuman primate, primate, etc.), the capacity of the individual's immune system to synthesize antibodies, the degree of protection desired, the formulation of the vaccine, the treating doctors assessment of the medical situation, and other relevant factors. It is expected that the amount will fall in a relatively broad range that can be determined through routine trials.

The composition may be administered parenterally, e.g., by injection, either subcutaneously or intramuscularly. In some embodiments, the composition is administered to the mammal by intradermal or intramuscular injection. Additional formulations suitable for other modes of administration include oral and pulmonary formulations, nasal formulations, suppositories, and transdermal applications. Oral formulations may be preferred for certain viral proteins. Dosage treatment may be a single dose schedule or a multiple dose schedule. The immunogenic composition may be administered in conjunction with other immunoregulatory agents.

In another aspect, the invention provides a method of eliciting an immune response against cytomegalovirus, comprising administering to a subject in need thereof an immunologically effective amount of the polypeptide and/or an immunogenic composition described herein, which comprises the proteins, DNA molecules, RNA molecules (e.g., self-replicating RNA molecules), or VRPs as described above. In certain embodiments, the immune response comprises the production of neutralizing antibodies against CMV.

The immune response can comprise a humoral immune response, a cell-mediated immune response, or both. In some embodiments an immune response is induced against each delivered CMV protein. A cell-mediated immune response can comprise a Helper T-cell (Th) response, a CD8+ cytotoxic T-cell (CTL) response, or both. In some embodiments the immune response comprises a humoral immune response, and the antibodies are neutralizing antibodies.

Neutralizing antibodies block viral infection of cells. CMV infects epithelial cells and also fibroblast cells. In some embodiments the immune response reduces or prevents infection of both cell types. Neutralizing antibody responses can be complement-dependent or complement-independent. In some embodiments the neutralizing antibody response is complement-independent. In some embodiments the neutralizing antibody response is cross-neutralizing; i.e., an antibody generated against an administered composition neutralizes a CMV virus of a strain other than the strain used in the composition.

The polypeptide and/or immunogenic composition described herein may also elicit an effective immune response to reduce the likelihood of a CMV infection of a non-infected mammal, or to reduce symptoms in an infected mammal, e.g., reduce the number of outbreaks, CMV shedding, and risk of spreading the virus to other mammals.

In one aspect, the invention relates to a method for reducing CMV viral shedding in a mammal. In some embodiments, the invention relates to a method for reducing CMV viral shedding in urine in a mammal. In some embodiments, the invention relates to a method for reducing CMV viral shedding in saliva in a mammal. In another aspect, the invention relates to a method for reducing CMV viral titers in a mammal. In one aspect, the invention relates to a method for reducing CMV nucleic acids in serum in a mammal. The term "viral shedding" is used herein according to its plain ordinary meaning in medicine and virology and refers to the production and release of virus from an infected cell. In some embodiments, the virus is released from a cell of a mammal. In some embodiments, virus is released into the environment from an infected mammal. In some embodiments the virus is released from a cell within a mammal.

In one aspect, the invention relates to a method for reducing CMV viral shedding in a mammal. The method includes administering the modified CMV gB polypeptide and/or immunogenic composition described herein to the mammal that is infected with or is at risk of a CMV infection. In one embodiment, the reduction in CMV viral shedding in a mammal is as compared to the viral shedding in mammals that were not administered the modified CMV gB. In another embodiment, the reduction in CMV viral shedding in a mammal is as compared to the viral shedding following an administration of a CMV pentamer alone or following an administration of a CMV pentamer in the absence of the polypeptide.

In some embodiments, the mammal is a human. In some embodiments, the human is a child, such as an infant. In some other embodiments, the human is female, including an adolescent female, a female of childbearing age, a female who is planning pregnancy, a pregnant female, and females who recently gave birth. In some embodiments, the human is a transplant patient.

In one embodiment, the challenge cytomegalovirus strain is a human CMV strain. In one embodiment, the challenge cytomegalovirus strain is homologous to the CMV strain from which the polypeptide is derived. In another embodiment, the challenge cytomegalovirus strain is homologous to the CMV strain VR1814. In another embodiment, the challenge cytomegalovirus strain is homologous to the CMV strain Towne.

In one embodiment, the challenge cytomegalovirus strain is a human CMV strain that is heterologous to the CMV strain from which the modified CMV gB polypeptide is derived. In another embodiment, the challenge cytomegalovirus strain is a human CMV strain that is heterologous to the VR1814 CMV strain. In another embodiment, the challenge cytomegalovirus strain is the VR1814 CMV strain. In another embodiment, the challenge cytomegalovirus strain is a human CMV strain that is heterologous to the CMV strain Towne. In another embodiment, the challenge cytomegalovirus strain is the CMV strain Towne.

In another embodiment, the challenge cytomegalovirus strain is a rhesus CMV strain homologous to the macacine herpesvirus 3 isolate 21252 CMV strain. In another embodiment, the challenge cytomegalovirus strain is the macacine herpesvirus 3 isolate 21252 CMV strain.

A useful measure of antibody potency in the art is "50% neutralization titer." Another useful measure of antibody potency is any one of the following: a "60% neutralization titer"; a "70% neutralization titer"; a "80% neutralization titer"; and a "90% neutralization titer." To determine, for example, a 50% neutralizing titer, serum from immunized animals is diluted to assess how dilute serum can be yet retain the ability to block entry of 50% of infectious viruses into cells. For example, a titer of 700 means that serum retained the ability to neutralize 50% of infectious virus after being diluted 700-fold. Thus, higher titers indicate more potent neutralizing antibody responses. In some embodiments, this titer is in a range having a lower limit of about 200, about 400, about 600, about 800, about 1000, about 1500, about 2000, about 2500, about 3000, about 3500, about 4000, about 4500, about 5000, about 5500, about 6000, about 6500, or about 7000. The 50%, 60%, 70%, 80%, or 90% neutralization titer range can have an upper limit of about 400, about 600, about 800, about 1000, about 1500, about 2000, about 2500, about 3000, about 3500, about 4000, about 4500, about 5000, about 5500, about 6000, about 6500, about 7000, about 8000, about 9000, about 10000, about 1 1000, about 12000, about 13000, about 14000, about 15000, about 16000, about 17000, about 18000, about 19000, about 20000, about 21000, about 22000, about 23000, about 24000, about 25000, about 26000, about 27000, about 28000, about 29000, or about 30000. For example, the 50% neutralization titer can be about 3000 to about 6500. "About" means plus or minus 10% of the recited value. Neutralization titer can be measured as described in the specific examples, below.

An immune response can be stimulated by administering proteins, DNA molecules, RNA molecules (e.g., self-replicating RNA molecules or nucleoside modified RNA molecules), or VRPs to an individual, typically a mammal, including a human. In some embodiments the immune response induced is a protective immune response, i.e., the response reduces the risk or severity of or clinical consequences of a CMV infection. Stimulating a protective immune response is particularly desirable in some populations particularly at risk from CMV infection and disease. For example, at-risk populations include solid organ transplant (SOT) patients, bone marrow transplant patients, and hematopoietic stem cell transplant (HSCT) patients. VRPs can be administered to a transplant donor pre-transplant, or a transplant recipient pre- and/or post-transplant. Because vertical transmission from mother to child is a common source of infecting infants, administering VRPs to a woman who is pregnant or can become pregnant is particularly useful.

Administration of the compositions provided by the present disclosure, such as pharmaceutical compositions, can be carried out using standard routes of administration. Any suitable route of administration can be used. For example, a composition can be administered intramuscularly, intraperitoneally, subcutaneously, or transdermally. Some embodiments will be administered through an intra-mucosal route such as intra-orally, intra-nasally, intra-vaginally, and intra-rectally. Compositions can be administered according to any suitable schedule.

Also provided herein is a method of inhibiting cytomegalovirus entry into a cell, comprising contacting the cell with the immunogenic composition described herein.

In one aspect, the invention relates to compositions that include a polypeptide described above. In another aspect, the invention relates to compositions that include a nucleic acid molecule or vector encoding such polypeptide. In a further aspect, the invention relates to compositions that include a polypeptide described above and a nucleic acid molecule or vector encoding such polypeptide.

In some embodiments, the composition is an immunogenic composition capable of eliciting an immune response against CMV in a subject. In some particular embodiments, the immunogenic composition is a pharmaceutical composition, which includes a polypeptide provided by the present disclosure and a pharmaceutically acceptable carrier. In still other embodiments, the pharmaceutical composition is a vaccine.

In some embodiments, a composition, such as an immunogenic composition or a vaccine, includes two or more different polypeptides described above. The two or more different polypeptides may include the same introduced amino acid mutations but may be derived from gB from different HCMV strains or subtypes. In another embodiment, the two or more different polypeptides may include amino acid mutations, as compared to a native HCMV gB, that differ from one another.

In preferred embodiments, the polypeptide is soluble in aqueous solution. In some embodiments, the polypeptide is soluble in a solution that lacks detergent.

Antibodies and Diagnostic Uses

The polypeptides described above may be used to produce antibodies, both polyclonal and monoclonal. If polyclonal antibodies are desired, a selected mammal (e.g., mouse, rabbit, goat, guinea pig, horse, etc.) is immunized with an immunogenic polypeptide bearing a CMV epitope(s). Serum from the immunized animal is collected and treated according to known procedures. If serum containing polyclonal antibodies to a CMV epitope contains antibodies to other antigens, the polyclonal antibodies can be purified by immunoaffinity chromatography. Techniques for producing and processing polyclonal antisera are known in the art.

Monoclonal antibodies directed against CMV epitopes can also be readily produced by one skilled in the art. The general methodology for making monoclonal antibodies by hybridomas is known. Immortal antibody-producing cell lines can be created by cell fusion, and also by other techniques such as direct transformation of B lymphocytes with oncogenic DNA, or transfection with Epstein-Barr virus. Panels of monoclonal antibodies produced against CMV epitopes can be screened for various properties; i.e., for isotype, epitope affinity, etc.

Antibodies, both monoclonal and polyclonal, which are directed against CMV epitopes are particularly useful in diagnosis, and those which are neutralizing are useful in passive immunotherapy. Monoclonal antibodies, in particular, may be used to raise anti-idiotype antibodies.

Both the polypeptides which react immunologically with serum containing CMV antibodies, and the antibodies raised against these polypeptides, may be useful in immunoassays to detect the presence of CMV antibodies, or the presence of the virus, in biological samples, including for example, blood or serum samples. Design of the immunoassays is subject to a great deal of variation, and a variety of these are known in the art. For example, the immunoassay may utilize the polypeptide having the sequence set forth in any one of SEQ ID NOs: 2-106.

Alternatively, the immunoassay may use a combination of viral antigens derived from the polypeptides described herein. It may use, for example, a monoclonal antibody directed towards at least one polypeptide described herein, a combination of monoclonal antibodies directed towards the polypeptides described herein, monoclonal antibodies directed towards different viral antigens, polyclonal antibodies directed towards the polypeptides described herein, or polyclonal antibodies directed towards different viral antigens. Protocols may be based, for example, upon competition, or direct reaction, or may be sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the polypeptides of the invention containing CMV epitopes or antibodies directed against epitopes in suitable containers, along with the remaining reagents and materials required for the conduct of the assay, as well as a suitable set of assay instructions.

The polynucleotide probes can also be packaged into diagnostic kits. Diagnostic kits include the probe DNA, which may be labeled; alternatively, the probe DNA may be unlabeled and the ingredients for labeling may be included in the kit. The kit may also contain other suitably packaged reagents and materials needed for the particular hybridization protocol, for example, standards, as well as instructions for conducting the test.

Some embodiments of the present disclosure provide a HCMV vaccine that includes at least one ribonucleic acid (RNA) polynucleotide having an open reading frame encoding at least one HCMV antigenic polypeptide or an immunogenic fragment thereof and at least one 5' terminal cap. In some embodiments, a 5' terminal cap is 7mG(5')ppp(5') NlmpNp.

Some embodiments of the present disclosure provide a HCMV vaccine that includes at least one ribonucleic acid (RNA) polynucleotide having an open reading frame encoding at least one HCMV antigenic polypeptide or an immunogenic fragment thereof, wherein the at least one ribonucleic acid (RNA) polynucleotide has at least one chemical modification. In some embodiments, the at least one ribonucleic acid (RNA) polynucleotide further comprises a second chemical modification. In some embodiments, the at least one ribonucleic acid (RNA) polynucleotide having at least one chemical modification has a 5' terminal cap. In some embodiments, the at least one chemical modification is selected from pseudouridine, N1-methylpseudouridine, N1-ethylpseudouridine, N1-ethylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

In some embodiments, the chemical modification is selected from the group consisting of pseudouridine, N1-methylpseudouridine, N1-ethylpseudouridine, 2-thiouridine, 4'-thiouridine, 5-methylcytosine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine, and 2'-O-methyl uridine.

Some embodiments of the present disclosure provide a HCMV vaccine that includes at least one ribonucleic acid (RNA) polynucleotide having an open reading frame encoding at least one HCMV antigenic polypeptide or an immunogenic fragment thereof, wherein at least 80% (e.g., 85%, 90%, 95%, 98%, 99%, 100%) of the uracil in the open reading frame have a chemical modification, optionally wherein the vaccine is formulated in a lipid nanoparticle. In some embodiments, 100% of the uracil in the open reading frame have a chemical modification. In some embodiments, a chemical modification is in the 5-position of the uracil. In some embodiments, a chemical modification is a N1-methyl pseudouridine.

Some embodiments of the present disclosure provide a HCMV vaccine that is formulated within a cationic lipid nanoparticle, also referred to herein as ionizable cationic lipid nanoparticles, ionizable lipid nanoparticles and lipid nanoparticles, which are used interchangeably. In some embodiments, the lipid nanoparticle comprises a cationic lipid, a PEG-modified lipid, a sterol and a non-cationic lipid. In some embodiments, the cationic lipid is an ionizable cationic lipid and the non-cationic lipid is a neutral lipid, and the sterol is a cholesterol. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319). In some embodiments, the lipid nanoparticle has a molar ratio of about 20-60% cationic lipid, about 5-25% non-cationic lipid, about 25-55% sterol, and about 0.5-15% PEG-modified lipid. In some embodiments, the nanoparticle has a polydiversity value of less than 0.4. In some embodiments, the nanoparticle has a net neutral charge at a neutral pH. In some embodiments, the nanoparticle has a mean diameter of 50-200 nm.

In some embodiments, 80% of the uracil in the open reading frame have a chemical modification. In some embodiments, 100% of the uracil in the open reading frame have a chemical modification. In some embodiments, the chemical modification is in the 5-position of the uracil. In some embodiments, the chemical modification is N1-methylpseudouridine, N1-ethylpseudouridine. In some embodiments, the vaccine is formulated within a lipid nanoparticle. In some embodiments, the lipid nanoparticle comprises a cationic lipid, a PEG-modified lipid, a sterol and a non-cationic lipid. In some embodiments, the cationic lipid is an ionizable cationic lipid and the non-cationic lipid is a neutral lipid, and the sterol is a cholesterol. In some embodiments, the cationic lipid is selected from the group consisting of 2,2-dilinoleyl-4-dimethylaminoethyl-[1,3]-dioxolane (DLin-KC2-DMA), dilinoleyl-methyl-4-dimethylaminobutyrate (DLin-MC3-DMA), and di((Z)-non-2-en-1-yl) 9-((4-(dimethylamino)butanoyl)oxy)heptadecanedioate (L319).

Some embodiments of the present disclosure provide methods of inducing an antigen specific immune response in a subject, comprising administering to the subject a HCMV RNA vaccine in an amount effective to produce an antigen specific immune response. In some embodiments, an antigen specific immune response comprises a T cell response or a B cell response. In some embodiments, an antigen specific immune response comprises a T cell response and a B cell response. In some embodiments, a method of producing an antigen specific immune response involves a single administration of the vaccine. In some embodiments, a method further includes administering to the subject a booster dose of the vaccine. In some embodiments, a vaccine is administered to the subject by intradermal or intramuscular injection.

Also provided herein are HCMV RNA vaccines for use in a method of inducing an antigen specific immune response in a subject, the method comprising administering the vaccine to the subject in an amount effective to produce an antigen specific immune response.

Further provided herein are uses of HCMV RNA vaccines in the manufacture of a medicament for use in a method of inducing an antigen specific immune response in a subject, the method comprising administering the vaccine to the subject in an amount effective to produce an antigen specific immune response.

Further provided herein are methods of preventing or treating HCMV infection comprising administering to a subject the vaccine of the present disclosure. The HCMV vaccine disclosed herein may be formulated in an effective amount to produce an antigen specific immune response in a subject.

The term "polypeptide variant" refers to molecules which differ in their amino acid sequence from a native or reference sequence. The amino acid sequence variants may possess substitutions, deletions, and/or insertions at certain positions within the amino acid sequence, as compared to a native or reference sequence. Ordinarily, variants possess at least 50% identity to a native or reference sequence. In some embodiments, variants share at least 80%, or at least 90% identity with a native or reference sequence.

In some embodiments "variant mimics" are provided. As used herein, the term "variant mimic" is one which contains at least one amino acid that would mimic an activated sequence. For example, glutamate may serve as a mimic for phosphoro-threonine and/or phosphoro-serine. Alternatively, variant mimics may result in deactivation or an inactivated product containing the mimic, for example, phenylalanine may act as an inactivating substitution for tyrosine; or alanine may act as an inactivating substitution for serine. "Orthologs" refers to genes in different species that evolved from a common ancestral gene by speciation. Normally, orthologs retain the same function in the course of evolution. Identification of orthologs is critical for reliable prediction of gene function in newly sequenced genomes. "Analogs" is meant to include polypeptide variants which differ by one or more amino acid alterations, for example, substitutions, additions or deletions of amino acid residues that still maintain one or more of the properties of the parent or starting polypeptide.

The present disclosure provides several types of compositions that are polynucleotide or polypeptide based, including variants and derivatives. These include, for example, substitutional, insertional, deletion and covalent variants and derivatives. The term "derivative" is used synonymously with the term "variant" but generally refers to a molecule that has been modified and/or changed in any way relative to a reference molecule or starting molecule.

As such, polynucleotides encoding peptides or polypeptides containing substitutions, insertions and/or additions, deletions and covalent modifications with respect to reference sequences, in particular the polypeptide sequences disclosed herein, are included within the scope of this disclosure. For example, sequence tags or amino acids, such as one or more lysines, can be added to peptide sequences (e.g., at the N-terminal or C-terminal ends). Sequence tags can be used for peptide detection, purification or localization. Lysines can be used to increase peptide solubility or to allow for biotinylation. Alternatively, amino acid residues located at the carboxy and amino terminal regions of the amino acid sequence of a peptide or protein may optionally be deleted providing for truncated sequences. Certain amino acids (e.g., C-terminal or N-terminal residues) may alternatively be deleted depending on the use of the sequence, as for example, expression of the sequence as part of a larger sequence which is soluble, or linked to a solid support. "Substitutional variants" when referring to polypeptides are those that have at least one amino acid residue in a native or starting sequence removed and a different amino acid inserted in its place at the same position. Substitutions may be single, where only one amino acid in the molecule has been substituted, or they may be multiple, where two or more amino acids have been substituted in the same molecule.

In some embodiments, the mutant CMV gB polypeptide is a truncated polypeptide lacking one or more of the following domain sequences as compared to SEQ ID NO: 1: (1) Domain V (residues 124-344), (2) MPR domain (residues 705-750), (3) TM domain (residues 751-772), or (3) the CT domain (residues 773-907). As used herein the term "truncated" shall mean that a sequence is missing some or all of the residues comprising a domain as set forth herein.

As described herein, CMV gB polypeptide comprises the following domains and residues (SEQ ID NO:1): (i) Domain I (residues 134-344), (ii) Domain II (residues 121-133 and 345-436), (iii) Domain III (residues 97-111, 475-539 and 640-648), (iv) Domain IV (residues 88-96, 540-639 and 551-641), (v) Domain V (residues 649-707), (vi) membrane-proximal region (MPR) (residues 705-750), (vii) transmembrane domain (TM) (residues 751-772), and (viii) cytoplasmic domain (CT) (residues 773-907). In another aspect, the ectodomain of CMV gB comprises residues 1-707 or 23-707 (without signal sequence) of SEQ ID NO: 1. In another aspect, the ectodomain is lacking Domain V and comprises residues 1-646 or 23-646 (without signal sequence).

EXAMPLES

The invention is further described by the following illustrative examples. The examples do not limit the invention in any way. They merely serve to clarify the invention.

Example 1: Isolation and Purification of Crosslinked and Native HCMV gB (Towne Strain) with Fusion Inhibitor During the sample preparation the HCMV fusion inhibitor (compound 28 described in Bloom et al., *Bioorganic & Medicinal Chemistry Letters* 14 (2004) 3401-3406; see also FIG. 5D) was added to each step during the virus concentration, processing, extraction and purification to inhibit conversion of gB to the postfusion form.

Following crosslinking of the proteins on the virion surface with bis(sulfosuccinimidyl) glutarate ($BS^2G$) and extraction of gB from the virion with detergent, the SM5-1

His/Strep-tagged Fab (Potzsch et al., *PLoS pathogens* 7(8): e1002172, 2011) was added to assist in purification and identification of gB by electron cryomicroscopy. The Fab-gB complexes were purified by an affinity column.

These extracted and purified proteins were then analyzed by electron cryomicroscopy for the presence of prefusion gB and used to solve the structure of a prefusion form.

Example 2: Electron Microscopy

Graphene oxide film-supported electron microscopy grids were prepared. The gB sample solutions were vitrified using a Vitrobot (ThermoFisher). The frozen grids were transferred to a FEI Titan Krios transmission electron microscope that operates at 300 kV. Target positions were set up in the SerialEM program, and high magnification (18000×) images were automatically collected with the program using a K2 direct detector camera (Gatan) using super resolution movie mode. The unbinned pixel size was 0.638 Å and the beam intensity was ~8e/unbin pixel/s. The total electron dose on the sample for each movie was ~$40 e/Å^2$. A total of 7,771 movies, each with 28 frames, was collected in three sessions.

Image Processing

Drift correction was done using the MotionCor2 program (Zheng S et al. *Nature Methods* 14, 331-332 (2017)), and the final micrographs were binned 2× and averaged from all frames. Contrast transfer function parameters were calculated with Gctf (Kai Zhang, *Journal of Structural Biology* 193(1), 1-12 (2016)). For particle picking, the published structure of HCMV gB in postfusion conformation (PDB: 5CXF) was used to generate a 30 Å density map using pdb2mrc (EMAN) (Ludtke, S. et al. *Journal of Structural Biology* 128(1), 82-97 (1999)). Projection images from this density maps was generated with project3d (EMAN) (FIG. 1) and used as a template for the automatic particle picking using Gautomatch program (Urnavicius L, et al. *Science* 347(6229):1441-1446 (2015)). Relion v2.1-beta (Scheres, S. H. *Journal of Structural Biology* 180(3): 519-530 (2012)) was used to extract the resulting ~1.9 million particles and to carry out all subsequent image processing steps, including 2D classification, 3D classification, auto-refinement and post-processing. The 2D classes were put into three groups based on the image features: the first group consisted of the 2D classes that showed features that resemble the crystallographically determined postfusion gB structure (>50%); the second group contained 2D classes with well resolved protein features that do not resemble the structural features from postfusion gB (<10%); the third group contained 2D classes that did not contain clearly defined protein (~40%) (FIG. 1). The first and second groups were further processed with 3D classification, auto refinement and post processing procedures with Relion. Following this processing, a ~3.5 Å resolution electron density map showing the postfusion conformation structure was reconstructed from the first group; a ~3.6 Å resolution electron density map showing a prefusion conformation structure was reconstructed from the second group. Based on these density maps and the known HCMV gB amino acid sequence (Towne strain P13201, SEQ ID NO:1), atomic models were built with the Coot program (Emsley P. et al *Acta Crystallogr D Biol Crystallogr* 66(Pt 4): 486-501 (2010)) for the prefusion and postfusion conformation structures. The postfusion gB crystal structure (PDB accession code 5CXF) and a crystal structure of a complex between the SM5-1 fab and gB domain II (PDB accession code 4OT1) were used as initial models for both structures. For the postfusion structure model, small adjustment was enough to obtain a good fit to the electron density. For the prefusion conformation model, domains I, II, III and IV from the reference PDB model could be docked as rigid bodies into the electron density map as a starting point. Then, adjustments of individual residues were made for optimal fitting. The model for domains V, MPR and TM were built de novo. The models were iteratively refined with the Phenix.real_space_refine tool (Afonine P V et al. *Acta Crystallogr D Struct Biol* 74(Pt 6): 531-544 (2018)) followed by local manual adjusting for several rounds.

Results

Sample Screening by cryoEM

The prefusion conformation of gB is unstable, with a propensity to rearrange to the postfusion state, including during sample handling. Therefore, the samples studied contained a mixture of gB conformers, complicating structure determination. In addition, there was no pre-existing reliable information on the arrangement of domains or the unique structural features of prefusion gB. We used direct visualization by electron microscopy and image processing to screen different sample preparation conditions. Image sorting by 2D and 3D classification permits multiple structures to be determined from heterogeneous samples. However, it requires a large data set so that enough particles for each structure can be combined to produce a class average with good signal. This was especially the case for the gB samples because prefusion gB was a small population in the mixtures. Therefore, we collected ~1,000 movies for each condition, and decided whether to pursue image processing with more data from the same sample or switch to another at the 2D classification stage. The structure of antibody Fab-bound postfusion conformation gB was readily obtained from many datasets. The projection images from these Fab-bound postfusion conformation structures were used as a reference to avoid selecting images for the prefusion image reconstruction. We selected any good class average with protein features that did not resemble any of the postfusion gB projection images for further image processing. We screened dozens of conditions for sample preparation with this strategy and eventually found a sample that produced some alternative 2D classes as a minor species in the particle populations (FIG. 1B, circled). Then a total of 7,771 movies were collected from that sample and used for determination of a prefusion gB structure.

Figure 1A:
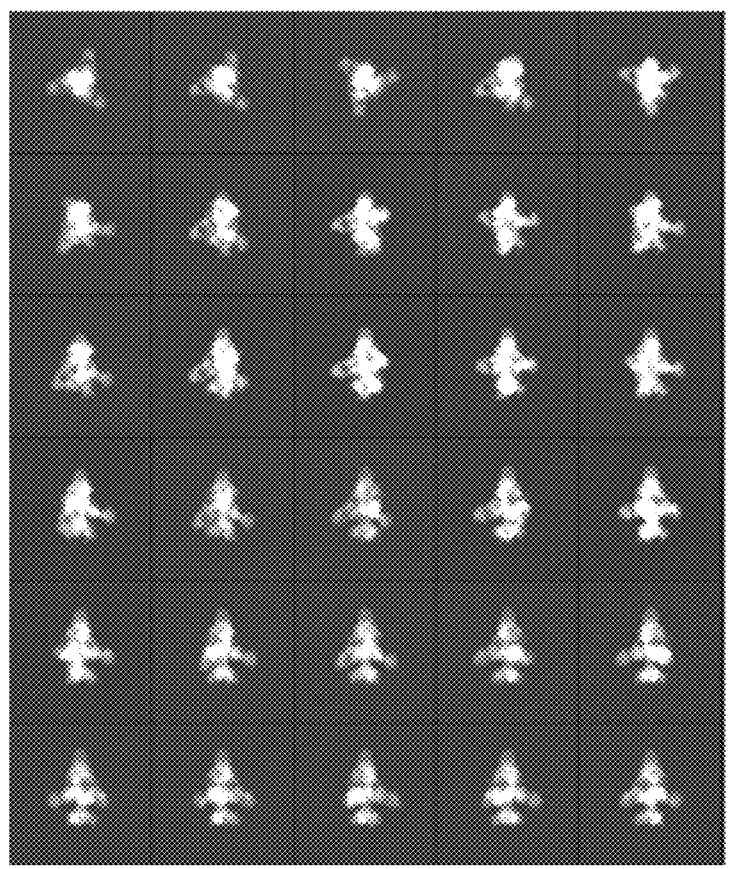
FIG. 1A-1B describe two-dimensional (2D) class averages of gB conformers.
Figure 1B:
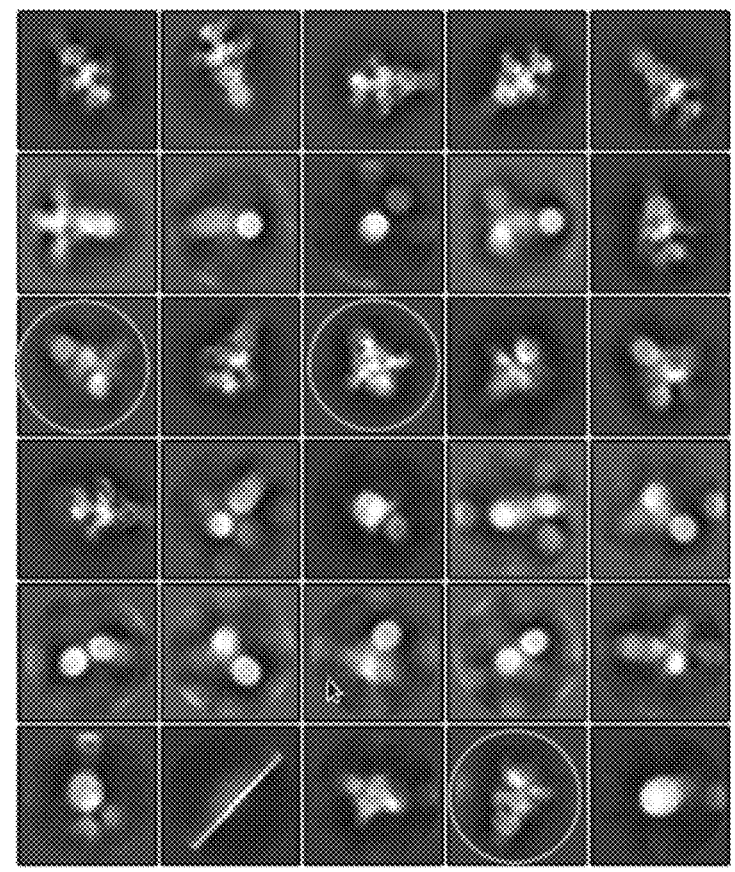

Projection images of the antibody Fab-bound postfusion gB structure are shown in FIG. 1A. The 2D class averages from the dataset collected are shown in FIG. 1B. Some classes that do not resemble any of the postfusion gB reference 2D projections are circled.

Obtaining a Prefusion Conformation Structure

Approximately 1.9 million raw particle images were automatically selected from the data set. After 2D classification, the images were grouped into a postfusion class (55% of the particle population) and a prefusion class (10% of the particle population). The two groups were further processed in 3D with C3 symmetry applied to yield a density map of SM5-1 Fab-bound postfusion gB at 3.5 Å resolution and a density map of SM5-1 Fab-bound prefusion gB at 3.6 Å resolution.

The X-ray crystallography-based models of the SM5-1 Fab and of the ectodomain of postfusion gB were fit to the postfusion density map with rigid body docking. Except for the constant domain of the Fab (which is likely too flexible to produce strong electron density), the density map of the postfusion gB-Fab complex and the model agreed well with each other (FIG. 3A). The membrane proximal region, transmembrane region and cytoplasmic domain were not resolved in our final postfusion gB density map, suggesting that these regions of postfusion gB are flexible either intrinsically or through detergent solubilization in the sample preparations (FIG. 2, lower line). The interaction of the Fab and DII of postfusion gB in the electron cryomicroscopy-based model agrees well with the previously determined crystal structure of the complex (PDB accession code 4OT1).

To build a prefusion gB model, guided by the known Fab binding position, domains I, II, III and part of domain IV from the postfusion gB crystal structure were docked into the density map of the prefusion gB-Fab complex individually and individual residues were manually adjusted as necessary for optimal fit of the electron density. The rest of the prefusion gB structure was built de novo. The amino acids of gB that were modeled in the prefusion structure are indicated in FIG. 2, the top line. The model of the prefusion gB-Fab complex fits most parts of the prefusion density map, and the presence of Fab density confirms the identity of gB in the novel structure (FIG. 3B).

The coordinates and structure factors for the model of the prefusion gB associated with the present Example are provided in Table 1A.

The Structure of gB in a Prefusion Conformation and Comparison to Postfusion gB

Figure 3B:
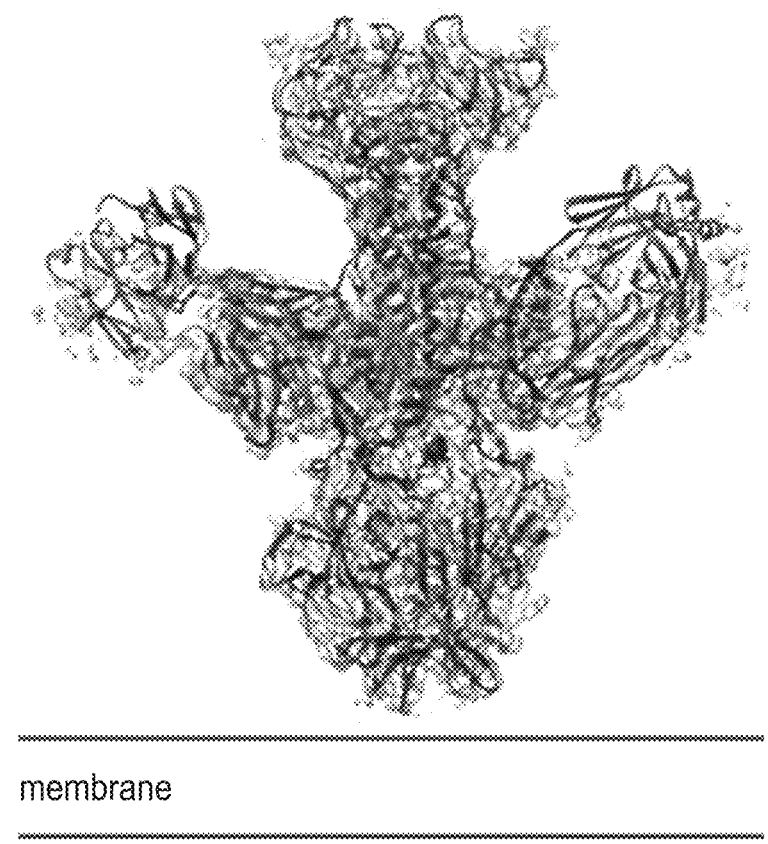
Figure 4A:
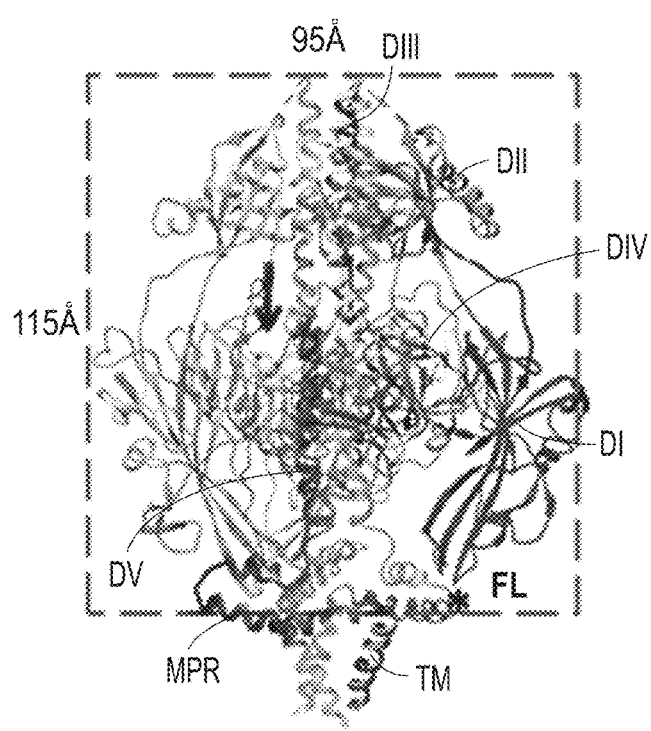
FIG. 4A-4B depict a comparison of the structures of gB in two conformations. The gB stabilized prefusion structure (FIG. 4A) and postfusion structure (FIG. 4B) are shown with one protomer to indicate the domains: I, II, III, IV, V, MPR and TM. The vertical black dashed line extending from the top of the prefusion structure represents residues missing from the model due to a less defined density map. The overall dimensions of the buildable ectodomain parts of the structure are indicated by the dashed line rectangles. The arrows indicate the direction pointed by the C-termini of the central 3-helix bundle in domain III of each conformation. The 115A dimension on the prefusion structure (FIG. 4A) indicates the height of the modeled part of the ectodomain.
Figure 4B:
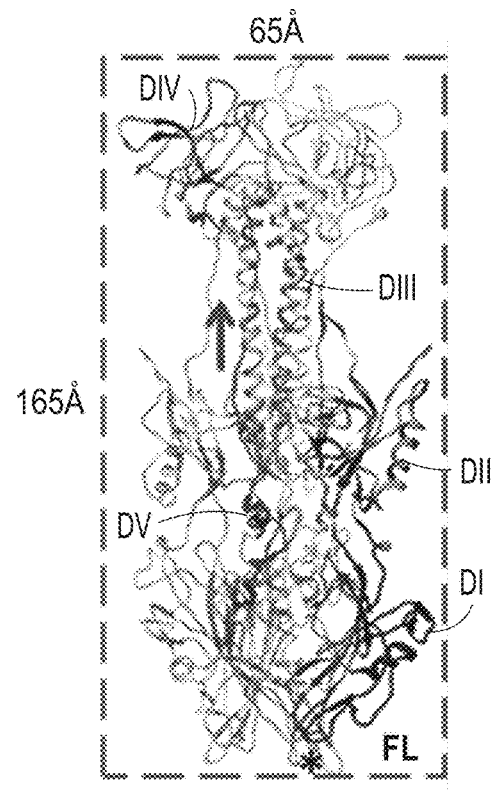

The electron density for the complex of prefusion gB and the SM5-1 Fab allowed the building of a prefusion gB model that includes the gB ectodomain, membrane proximal region (MPR—a helical region that is oriented parallel to the viral membrane), and single span transmembrane helix (TM) (FIG. 3B and FIG. 4B). The MPR and TM regions were not resolved in the structural data for postfusion gB or included in postfusion gB models.

The overall dimensions of prefusion and postfusion gB are different (FIG. 4A vs. FIG. 4B). The postfusion gB trimer ectodomain has a rod shape, with an approximate height of 165 Å (the distance between planes formed by proline 570 of each protomer at the membrane distal end and tryptophan 240 of the each protomer at the membrane proximal end; FIG. 4A). It has a width of approximately 65 Å (the distance between alanine 315 on adjacent protomers). The structures described here were derived from gB of HCMV strain Towne. Although there is some natural variations of gB amino acid sequence, the overall postfusion structure of Towne gB is almost identical to the postfusion structure of gB from the strain AD169 (PDB accession code 5CXF). Thus, the description of the postfusion gB structure applies to both strains with measurements from equivalent amino acids from sequence alignments.

The prefusion gB trimer has a more squat shape than the postfusion gB trimer (FIG. 4A vs. FIG. 4B). The distance between the plane formed by W240 of each protomer and the most membrane distal modeled residue in the prefusion structure, Q483, is roughly 115 Å. The prefusion model is 95 Å in width (measured by the distance between any two A315 from different protomers).

Figure 6A:
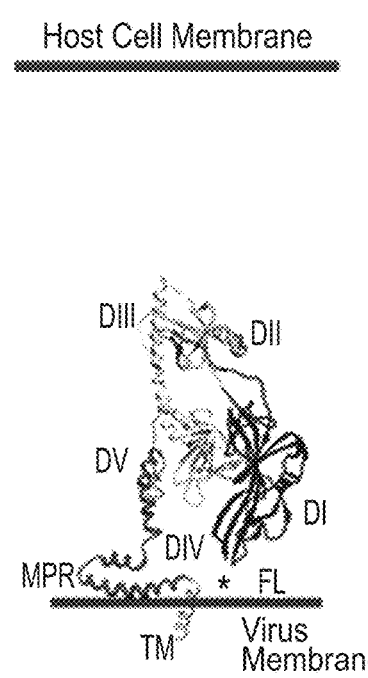
FIG. 6A-6C depict a model of structural rearrangements of gB during membrane fusion. FL (and asterisks)—fusion loop. DI—domain 1. DII—domain 2. DV—domain 5. TM—transmembrane region. The light blue line depicts the viral membrane. The lines depict membrane.

The individual subunit structures of domains I, II, III and IV are similar in the prefusion and postfusion conformations. However, the overall arrangement of these domains is very different in the two conformations (FIGS. 4A-4B and FIGS. 6A-6C). In the prefusion conformation, the fusion loops at the tip of DI and the C-termini of the central helix bundle in domain III all point in the same direction, toward the virion envelope, as identified by the position of the TM region (FIG. 4AI and FIG. 6A). In contrast, in the postfusion conformation, the fusion loops and the C-termini of the central helix bundle point in opposite directions (FIG. 4B and FIG. 6C).

In the prefusion structure, the hydrophobic residues in the fusion loops (residues Y155, I156, H157 and W240, L241) are in close proximity to the MPR and are likely surrounded by detergents (FIG. 4AI and FIG. 6A).

In the transition from prefusion to post fusion, domain II shifts from a position mid-way up the domain III central coiled-coil to a position at the membrane proximate end of the coiled-coil and near end of domain I opposite the fusion loops (FIG. 4A and FIG. 4B).

The structure of DIII (FIGS. 4A-4B and FIGS. 6A-6C) is very similar in the prefusion and postfusion conformations. The central helix in both conformations spans from L479 to P525, indicating a minimal rearrangement during the prefusion to postfusion transition. However, the other domains change their positions relative to the central helix of domain III, so that, as noted above, the direction of the DIII helix bundle (from N-terminal to C-terminal) points away from the fusion loops towards the distal end of the trimer in the postfusion conformation and toward the viral membrane, in the same direction as the fusion loops in the prefusion conformation.

In the prefusion structure, domain IV (FIG. 4A and FIG. 6A) is buried at the interface between domain 1 on the exterior of the trimer and domains III and V at the center of the trimer. In contrast, in the postfusion structure, domain IV forms a highly exposed "crown" at the membrane-distal tip of the trimer.

Domain V has different structures in prefusion gB (FIG. 4A and FIG. 6A) and postfusion gB (FIG. 4B and FIG. 6C). In prefusion gB, the N-terminal half of the domain (about residues 642-660) is sandwiched between domain 1 and domain IV of an adjacent protomer and is sequestered from solvent. The region between residue 683-704 of domain V forms a trimeric helix bundle with its counterpart in other protomers. This helix bundle is cuddled mostly inside of the pocket of the "crown" formed by domain IV. There is an additional short helix (approximately residues 710-719) linking the helix bundle from domain V to the MPR region. In contrast, in the postfusion conformation (FIG. 4B and FIG. 6C), domain V is solvent exposed and extends along the outside of domain III helix bundle and the groove formed by the interface between domain I from adjacent protomers.

Comparison of the prefusion and postfusion gB structures suggests a progression of conformational changes that is familiar from other well-studied fusion proteins (Harrison, S. C. *Virology* 0:498-507 (2015)). The comparison provides confidence that the structure described in this invention is, in fact, in a prefusion conformation. In the prefusion state (FIG. 6A), the fusion loops of domain I are buried by interaction with the MPR and potentially with the viral membrane. In the prefusion structure of the distant gB homolog, the vesicular stomatitis virus G glycoprotein, the fusion loops also point toward the viral membrane (also the anticipated position of an MPR region, which is not seen in that structure)(Roche et al. *Science* 315:843-8 (2007)).

Figure 6B:
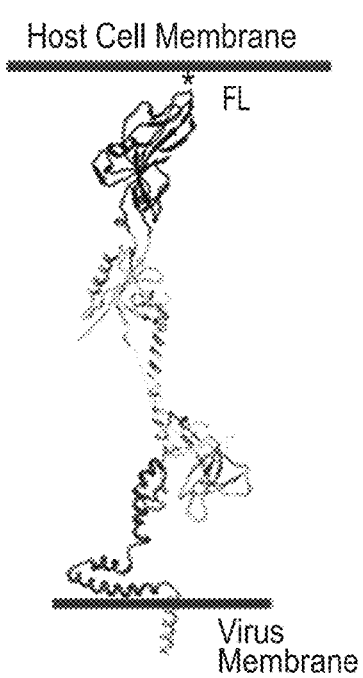
Figure 6C:
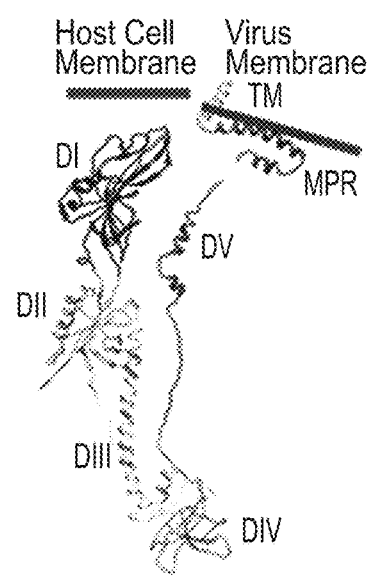

Based on analogy to other fusion proteins, it is likely that rearrangement proceeds with lengthening of the central helix as part of a transition to a proposed extended intermediate between the prefusion and postfusion states (FIG. 6B). In the proposed extended intermediate state, the TM region would still be anchored in the viral membrane, and the fusion loops, now extended far from the viral membrane at the tips of a rotated and translocated domain I, would interact with a cellular membrane. The transition from the proposed extended intermediate to the postfusion conformation would involve a fold-back so that the transmembrane region and the fusion loops are again in proximity to each other at the same end of the molecule, this time both interacting with the fused viral and cellular membrane (FIG. 6C).

We speculate that, in prefusion gB, there may be dynamic changes in the length of the central helix, with the prefusion structure we have determined representing a "snapshot" of a "breathing" molecule, locked into the conformation we see in the electron density by the fusion inhibitor and by the cross-linking agent used to prepare the sample studied by electron cryomicroscopy.

Stabilizing Factors for the Observed Prefusion Conformation

Figure 5A:
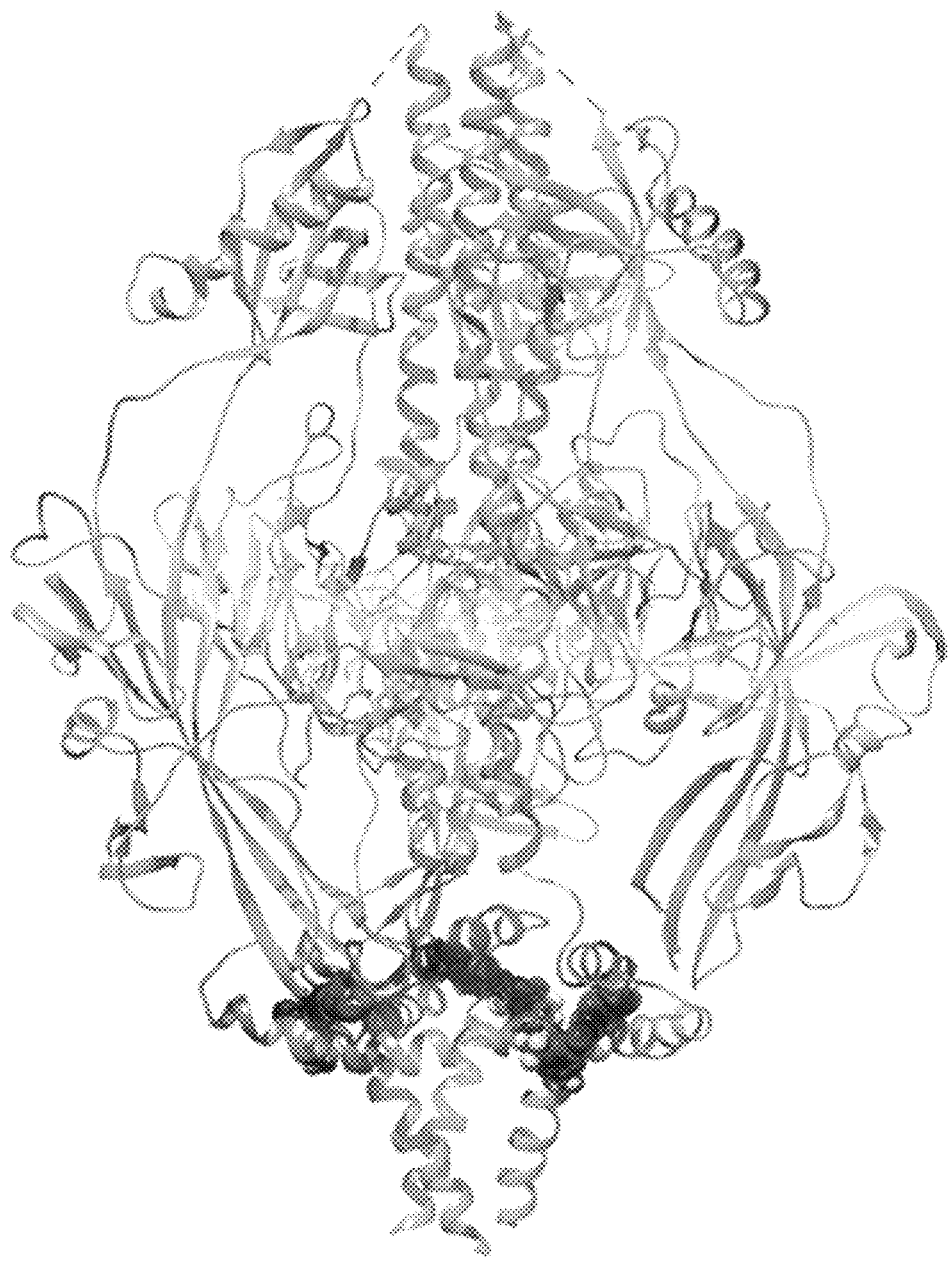
FIG. 5A-5D.
Figure 5B:
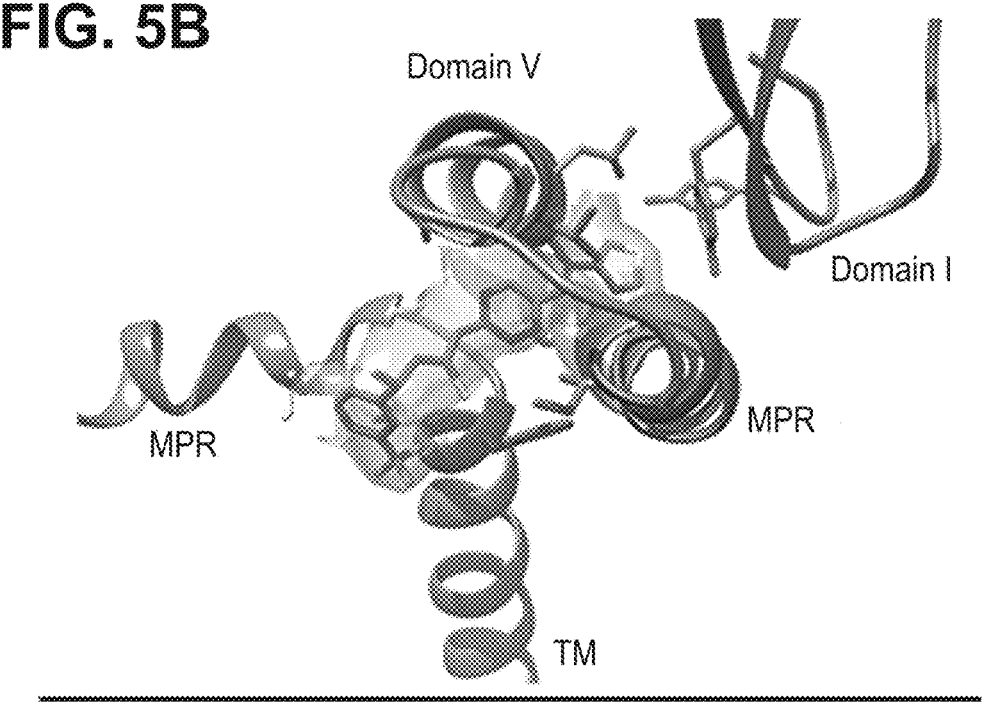
Figure 5C:
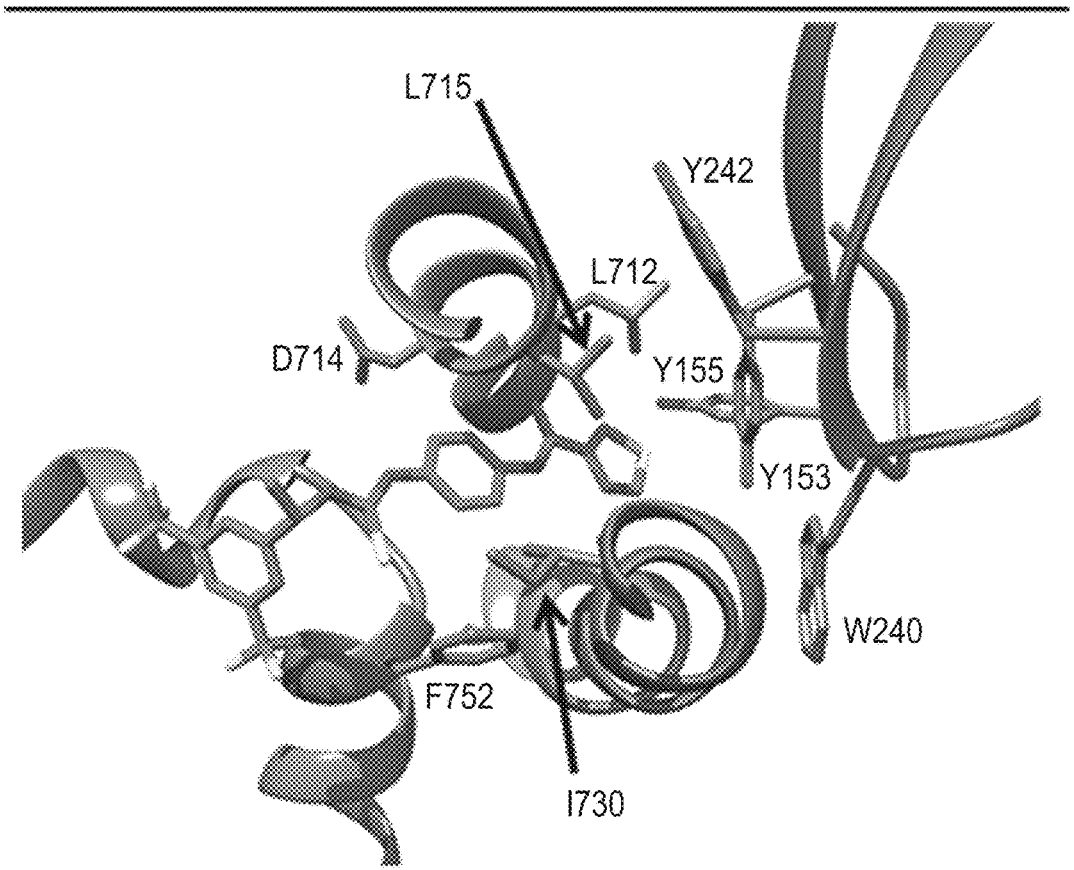

After modeling the gB amino acids into the electron density map, a region of density that was not filled by amino acid residues remained between the MPR, domain V, and the tip of domain I that contains the fusion loops (FIG. 5A). The size and shape of the unfilled density fits the chemical structure of the HCMV fusion inhibitor, N-{4-[({(1S)-1-[3,5-bis(trifluoromethyl)phenyl]ethyl}carbamothioyl)amino]phenyl}-1,3-thiazole-4-carboxamide (FIG. 5D), which had been present throughout the production of the sample studied by electron cryomicroscopy (FIG. 5B). The compound adopted a pose with a kink between the trifluoromethyl phenyl moiety and the rest of the compound. The thiazole forms contacts with hydrophobic residues of L712, A738 and Y153, Y155 from an adjacent protomer. The phenyl is surrounded in a hydrophobic environment formed by residues of L715, the aliphatic hydrocarbon of D714 from domain V, G734 and I 730 from MPR, and F752 from the TM domain of an adjacent protomer. The trifluoromethyl phenyl resides in a hydrophobic environment near the hinge between MPR and TM helixes from another protomer. It may act as a hook to prevent the outward movement of MPR and TM domains. In addition to the interaction coordinated by the inhibitor compound, the W240, Y242 from other fusion loop are forming van der waals interactions with the hydrophobic patch from the MPR region and L715 in domain V respectively. (FIG. 5C). These specific interactions around the fusion inhibitor would be expected to hold domain I, domain V, and the MPR together and restrict movements among domain I, domain V, and the MPR during the fusion process (FIGS. 6A-6C).

The effects of cross linking on the stability of the prefusion conformation were also tested. During the sample preparation steps, BS$^2$G cross linking reagents either were or were not added. In the absence of the cross linker, the ratio of particles in prefusion versus postfusion conformations was 1:100, while the ratio was 1:4 in the sample that had been cross linked by the BS$^2$G reagent. The cross linker was not identified in the electron density.

The prefusion structure of CMV gB and color versions of the prefusion and postfusion structures set forth in the Figures described herein may also be found in Liu et al. Science Advances 7(10): eabf3178 (2021), which is hereby incorporated by reference herein in its entirety.

Example 3: Expression and Purification of gB1666

For the production of gB1666, the PSB1666 construct was transiently transfected into Expi293F cells. The cell pellets were harvested 96 hours after transfection. The PSB1666 protein was purified in 25 mM HEPES pH 7.5, 250 mM NaCl, 0.02% DDM, 0.002% CHS, 3 µg/ml WAY-174865 (inhibitor, see FIG. 5D) through a series or processes of solubilization, affinity column and size exclusion chromatography. The protein was analyzed on SDS-PAGE and by EM with negative staining to ensure at least 50% of the proteins displaying prefusion conformation. The PSB1666 protein is expressed efficiently in transfection of Expi293F cells and 1L expression would generate ~0.1 mg of purified PSB1666 in high quality.

The polypeptide gB1666 (PSB1666) (SEQ ID NO: 57) includes a mutation in Domains I and IV. The polypeptide includes the following mutations, D217C and Y589C, relative to the corresponding wild-type gB (Towne) set forth in SEQ ID NO: 1.

Example 4: DNA-Expressed gB1666 is Immunogenic in Balb/c Mice

Figure 5D:
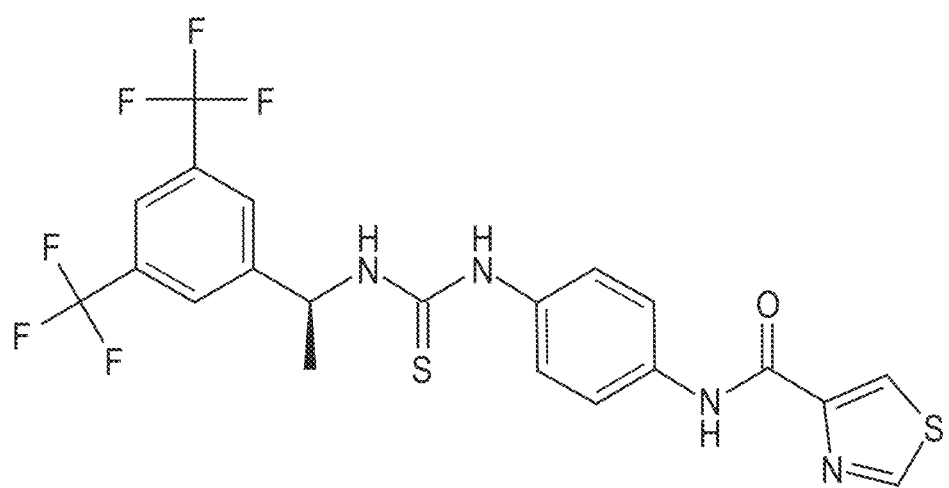

One of the proposed stabilized full length prefusion gB constructs, gB1666 (SEQ ID NO: 57), has been shown by EM to have an increased proportion of molecules in the prefusion conformation relative to wild type gB of the Towne strain after purification from transfected mammalian cells in the presence of a fusion inhibitor (WAY-174865; see FIG. 5D). To assess whether this molecule can elicit immune responses in vivo, the DNA sequence corresponding to gB1666 and wild type gB were cloned into an in-house mammalian expression vector. Ten Balb/c mice were electroporated with 100 ug of DNA encoding gB1666 twice at a three-week interval (DO and D21). An additional 10 mice were electroporated by the same protocol with DNA encoding wild type gB, and a third group was electroporated with a placebo, consisting of phosphate-buffered saline. Serum samples were collected at Day 28. ELISA was performed against recombinant gB protein produced from mammalian cells, based on the wild type sequence of Towne strain but with the transmembrane domain removed (Sino Biologicals) to determine the anti-gB IgG responses according to a standard protocol. Ten out of ten animals from the wild type gB DNA immunized mice and nine of ten gB1666 DNA immunized mice generated detectable anti-gB IgG titers (FIG. 11, showing mean±SD, LLOQ=25). The study demonstrates that gB1666 is immunogenic in Balb/c mice.

Example 5: Immunogenicity Study of Stabilized Prefusion gB1666 Protein

Immunogenicity study of gB1666 in mice. To evaluate the antibody response in mice, the following immunization scheme will be followed. At week 8, mice will be exsanguinated and the neutralization titers from the immunized animal serum will be determined and compared with those immunized with gB705 (postfuion) and/or gB wild type proteins.

TABLE 5

Mouse immunogenicity study design with gB1666 protein

| Group | No. of Mice | Immunogen | Adjuvant | Route | Dosing Schedule |
|---|---|---|---|---|---|
| 1 | 10 | gB705 (postfusion) (1.25 mcg/0.2 ml) | — | 0.2 ml/SC | Weeks 0, 3, 6 |
| 2 | 10 | gB705 (postfusion) (0.25 mcg/0.2 ml) | — | 0.2 ml/SC | Weeks 0, 3, 6 |
| 3 | 10 | gB1666 (in inhibitor-containing buffer) (1.25 mcg/0.2 ml) | — | 0.2 ml/SC | Weeks 0, 3, 6 |
| 4 | 10 | gB1666 (in inhibitor-containing buffer) (0.25 mcg/0.2 ml) | — | 0.2 ml/SC | Weeks 0, 3, 6 |
| 5 | 10 | gB wt (in inhibitor-containing buffer) (1.25 mcg/0.2 ml) | — | 0.2 ml/SC | Weeks 0, 3, 6 |

TABLE 5-continued

Mouse immunogenicity study design with gB1666 protein

| Group | No. of Mice | Immunogen | Adjuvant | Route | Dosing Schedule |
|---|---|---|---|---|---|
| 6 | 10 | gB wt (in inhibitor-containing buffer) (0.25 mcg/0.2 ml) | — | 0.2 ml/SC | Weeks 0, 3, 6 |
| 7 | 5 | Buffer (+Inhibitor) | — | 0.2 ml/SC | Weeks 0, 3, 6 |
| 8 | 5 | Buffer only | — | 0.2 ml/SC | Weeks 0, 3, 6 |

Example 6

In Example 2, we disclosed the electron cryomicroscopy (cryoEM) structure of prefusion human cytomegalovirus (HCMV) strain Towne glycoprotein B (gB) in complex with an antibody fragment. The gB used for structure determination was obtained by adding a small molecule fusion inhibitor, WAY-174865, to a fermentation of authentic HCMV in mammalian cell culture and maintaining the presence of the inhibitor throughout production and analysis of gB; purifying the virus; treating the virus with a chemical cross linker, bis(sulfosuccinimidyl) glutarate (BS$^2$G; 7.7 Å spacer arm); extracting gB from the virus with detergent; binding gB on the virion with an affinity tagged antibody fragment; and purifying the gB by affinity and sizing columns. We also disclosed the use of the prefusion gB cryoEM structure to engineer mutations that stabilize gB in the prefusion state. Specifically, we disclosed the recombinant gB protein gB1666, in which two residues are mutated to cysteine (D217C, Y589C). The resulting formation of an engineered disulfide bond between C217 and C589 increases the conformational stability of the recombinant gB in the prefusion state. gB1666 maintained prefusion structural features when it was expressed in Expi293F cells and purified in the presence of a fusion inhibitor, compound WAY-174865. In the absence of the inhibitor, gB1666 tends to undergo a conformational change and lose its prefusion structural state. Loss of prefusion conformational stability in the absence of inhibitor is not a desirable characteristic for use of the recombinant glycoprotein as an antigen for immunization. Even if gB1666 were formulated with the inhibitor, there is a risk that, upon injection into a person or animal, the dilution of the inhibitor in vivo would lead to its dissociation from gB1666 and the loss of prefusion conformation of gB1666. Thus, it is desired that HCMV gB be stabilized sufficiently in the prefusion conformation to remain in the prefusion state in the absence of WAY-174865. It is also preferable that a prefusion gB immunogen includes a soluble ectodomain to improve manufacturability, improve solubility, improve homogeneity, and reduce or eliminate the need for formulation with a detergent or other excipient to prevent aggregation or precipitation mediated by the gB transmembrane region.

We now report the invention, through a structure-based engineering approach, of new mutations in HCMV gB that confer these improved characteristics for use of prefusion gB as an immunogen. First, we determined the structure by cryoEM of gB1666, which was solubilized by anchoring in nanodiscs and stabilized in the prefusion conformation by the presence of WAY-174865 (FIG. 12). Most of the new structure of the recombinant, D217C and Y589C mutant gB is similar to the structure of the virion-derived, chemically cross-linked and antibody fragment bound HCMV Towne prefusion gB that we determined previously, but there are subtle differences between the two structures in certain local regions. The difference in the structures could reflect several differences in the preparations: first, the presence of the engineered disulfide bond in gB1666, which should restrict the breathing motion of the glycoprotein; second, the anchoring of gB1666 in a nanodisc, which provides a more natural local lipid environment for the transmembrane domain than the detergents used to extract and maintain gB in solution for the previous structure determination; third, the absence of chemical cross-linking of gB1666; fourth, the higher resolution of the new structure at 3.3 Å, compared to the 3.6 Å resolution of the previous structure, allowing more accurate modeling of amino acid side chains.

Based on the new structural information, we designed additional stabilizing mutations on the background of the full length gB construct pSB1666 (Table 6 and Table 7). We hypothesized that adding these additional mutations on the pSB1666 background would further stabilize the gB in a prefusion state (FIG. 13). For example, cysteine mutations at residues M371 and W506 may introduce a disulfide bond between domains II and III; cysteine mutations at the pairs of (F541, E681) and (N524,M684) may introduce disulfide bonds between domains IV and V; mutations of residues E686, D679 to hydrophobic residues could remove a locally destabilizing same charge repulsion patch and increase protein stability. Recombinant glycoproteins with a selection of the new, added mutations were expressed and purified in the absence of fusion inhibitor and without chemical cross-linking. The electrophoretic mobility of the expressed glycoproteins by SDS-PAGE showed the expected apparent molecular weight and heterogeneity consistent with glycosylation (FIG. 14). The samples were stored at 4° C., and aliquots were taken for negatively stained electron microscopy analysis on day 1 and day 7. In the 2D class averaged images, triangular shape features that resemble "top views" of the prefusion conformation of the gB were apparent. The ratio of particles in the population belonging to prefusion and postfusion classes were 5:1 on day 1 and 3:1 at day 7 (FIG. 15).

Based on the new structural information, we designed several soluble, detergent-free gB ectodomains (Table 8) with prefusion-stabilizing mutations as illustrated in FIGS. 16A-16D. The purified ectodomain of HCMV gB, residues 1-707, formed rosette-like aggregates, in which gB proteins associated through their exposed fusion loops. To eliminate aggregation and increase protein secretion to the condition media, we replaced four exposed hydrophobic residues within the fusion loops with the corresponding more hydrophilic amino acids from herpes simplex virus-1 (HSV-1) gB, e.g. YIH (155-157)→GHR, W240→A. We also mutated the exposed Cys246 to Ser (C246→S) to prevent formation of spurious disulfide bonds. To further stabilize the prefusion trimeric state of the antigen, we either introduced cysteine residues capable of forming inter-protomer disulfide bonds or appended C-terminal trimerization motifs, e.g. GCN4 or foldon from T4-bacteriophage fibritin. Disulfide mutations, e.g. D217C-Y589C, M317C-W506C, N524C-M684C, were further introduced to lock the proteins into the prefusion state. Recombinant glycoproteins were expressed, secreted to the conditioned media and purified in the absence of fusion inhibitor and without chemical detergent. Notably, the recombinant variant, fused to a GCN4 trimerization motif, showed optimal size-exclusion chromatography profile (FIG. 17). The negatively stained electron microscopy showed recombinant proteins, gB2555 and gB2556, as monodispersed proteins in the absence of inhibitor and detergents. Expected gB protein features are observed in the 2D class averaged images (FIG. 18 and FIG. 19). These results confirm that these engineered constructs are suitable to be used as a framework to add more stabilizing mutations towards a prefusion form of gB in the absence of inhibitor and detergents if needed.

The coordinates and structural factors for the model of the prefusion gB associated with the present Example are provided in Table 1B.

TABLE 6

Exemplary cysteine pair mutations for disulfide bond stabilization

| Row | Mutations |
|---|---|
| 1 | D217C, Y589C |
| 2 | I356C, A500C |
| 3 | S367C, A500C |
| 4 | S367C, A503C |
| 5 | M371C, A505C |
| 6 | M371C, W506C |
| 7 | T374C, A503C |
| 8 | Y160C, Y708C |
| 9 | L162C, M716C |
| 10 | N524C, M684C |
| 11 | G99C, A267C |
| 12 | T100C, R258C |
| 13 | T221C, E657C |
| 14 | S223C, T659C |
| 15 | F541C, E681C |
| 16 | L603C, Y667C |
| 17 | N605C, K670C |
| 18 | R607C, N688C |

TABLE 6-continued

Exemplary cysteine pair mutations for disulfide bond stabilization

| Row | Mutations |
|---|---|
| 19 | E609C, K691C |

TABLE 7

Exemplary charge mutations for stabilization

| Row | Mutations |
|---|---|
| 1 | E686L |
| 2 | E686I |
| 3 | D679A |
| 4 | R354F |
| 5 | R573F |
| 6 | D101L, K260L |

TABLE 8

Construct mutations.

| Construct | Mutation 1 | Mutation 2 | Mutation 3 | Mutation 4 |
|---|---|---|---|---|
| pSB1688 | N524C | M684C | | |
| pSB2455 | M371C | W506C | | |
| pSB2456 | F541C | E681C | | |
| pSB2457 | D217C | Y589C | M371C | W506C |
| pSB2459 | D217C | Y589C | N524C | M684C |
| pSB1666 | D217C | Y589C | | |

The constructs set forth in Table 8 were made for the purpose of testing the presence of prefusion gB in the purified recombinant protein preparation under different conditions.

TABLE 9

Exemplary soluble, detergent-free gB ectodomain proteins

| Code | gB* | Mutations | C-Terminus Fusion Sequence |
|---|---|---|---|
| gB707 | gB (1-707) | D217C, Y589C | |
| gB2264 | gB (1-707) | D217C, Y589C, D703C, P704C | |
| gB2265 | gB (1-707) | D217C, Y589C, Y696C, V697C | |
| gB2266 | gB (1-702) | D217C, Y589C | RIKQIEDKIEEILSKQYHIENEIARIKKLIG (SEQ ID NO: 272) |
| gB2267 | gB (1-702) | D217C, Y589C | KIEEILSKQYHIENEIARIKKLIG (SEQ ID NO: 269) |
| gB2268 | gB (1-702) | D217C, Y589C | KIYHIENEIARIKKLIG (SEQ ID NO: 273) |
| gB2269 | gB (1-703) | D217C, Y589C | LSAIGGYIPEAPRDGQAYVRKDGEWVLLSTFL (SEQ ID NO: 274) |
| gB2555 | gB (1-702) | D217C, M371C, W506C, Y589C | KIEEILSKQYHIENEIARIKKLIG (SEQ ID NO: 269) |
| gB2556 | gB (1-702) | D217C, N524C, Y589C, M684C | KIEEILSKQYHIENEIARIKKLIG (SEQ ID NO: 269) |
| gB2557 | gB (1-707) | D217C, N524C, Y589C, M684C, D703C, P704C | |

*Mutations, including YIH (155-157)→GHR, W240→A and C246→S, had been incorporated in gB to decrease aggregation and increase protein secretion.

Example 7: Overall Strategies to Engineer a Stabilized Prefusion gB

To engineer a stabilized prefusion gB, two strategies were used:

i) the first strategy is to strengthen the interactions in the prefusion structure, which include engineering disulfide bonds between the residues that are in close proximity in the prefusion structure and grafting stable structure motifs to the C-terminal end without disrupting the structures from other parts of the molecule; and ii) the second strategy is to remove the energetically unfavorable local structures from the prefusion conformation. These include: (a) removal of surface exposed hydrophobic residues, (b) changes of proline to non-proline and hydrophilic residues in the loops regions, and (c) removal and reengineering Domain V, which undergoes large conformational changes during the fusion process. The combination of such designs was used to obtain enough stabilization for the prefusion gB. The proteins carrying such designed mutations were individually purified and screened by their properties in size exclusion chromatography (SEC), thermal melting assay (TM) and their features from the electron microscopy images (EM).

A panel of mutant cysteine pair constructs was screened against the CMV gB full length post-fusion construct pSB1764. For the first round, each new construct included one mutant cysteine pair. The complete list of mutants that were screened are in Table 10.

TABLE 10

The list of one pair disulfide bond mutants that were screened on full length CMV gB
Postfusion gB Full length Construct pSB1764
Construct Framework CMV gB HAss FLAG/V23 . . . V907 (ACM48044.1) I675S/Thrombin His6
StrepTagII ** in pcDNA3.1(+)

| Construct name | Mutation 1 | Mutation 2 |
|---|---|---|
| pSB01579 | G99C | A267C |
| pSB01581 | T100C | S269C |
| pSB01582 | Q98C | G271C |
| pSB01656 | M96C | D660C |
| pSB01657 | Q98C | N658C |
| pSB01658 | T100C | R258C |
| pSB01659 | T100C | L656C |
| pSB01660 | T100C | N658C |
| pSB01662 | I117C | S407C |
| pSB01663 | Y153C | L712C |
| pSB01664 | L162C | M716C |
| pSB01665 | D217C | S587C |
| pSB01666 | D217C | Y589C |
| pSB01667 | S219C | F584C |
| pSB01668 | S219C | A585C |
| pSB01669 | S219C | N586C |
| pSB01671 | S223C | T659C |
| pSB01672 | W240C | A732C |
| pSB01673 | W240C | G735C |
| pSB01674 | Y242C | V728C |
| pSB01675 | Y242C | G731C |
| pSB01678 | S269C | N658C |
| pSB01679 | D272C | P614C |
| pSB01680 | V273C | V629C |
| pSB01681 | W349C | A650C |
| pSB01682 | S367C | A500C |
| pSB01683 | S367C | A503C |
| pSB01684 | K370C | Q501C |
| pSB01686 | I523C | I683C |
| pSB01687 | I523C | M684C |
| pSB01688 | N524C | M684C |
| pSB01691 | F541C | L680C |
| pSB01692 | L548C | P655C |
| pSB01693 | A549C | N658C |
| pSB01694 | S550C | P655C |
| pSB01695 | S550C | E657C |
| pSB01696 | Q591C | S668C |
| pSB01697 | L603C | Y667C |
| pSB01698 | G604C | L672C |
| pSB01699 | R607C | N688C |
| pSB01700 | T608C | Q692C |
| pSB01702 | E610C | S674C |
| pSB01703 | E610C | S675C |
| pSB01704 | Q612C | V663C |
| pSB01705 | V737C | F755C |
| pSB01707 | V741C | F755C |

TABLE 10-continued

The list of one pair disulfide bond mutants that were screened on full length CMV gB
Postfusion gB Full length Construct pSB1764
Construct Framework CMV gB HAss FLAG/V23 . . . V907 (ACM48044.1) I675S/Thrombin His6
StrepTagII ** in pcDNA3.1(+)

| Construct name | Mutation 1 | Mutation 2 |
|---|---|---|
| pSB01708 | D679S | N/A |
| pSB01709 | D679N | N/A |
| pSB01712 | E686S | N/A |
| pSB01713 | E686Q | N/A |
| pSB01715 | D646P | N/A |
| pSB02041 | E686F | N/A |
| pSB02043 | E686I | N/A |
| pSB02044 | E686V | N/A |

It was determined from the screen that cysteine pair D217C-Y589C (pSB1666), in combination with inhibitor WAY-174865, stabilized CMV gB in the prefusion state.

In the presence of the fusion inhibitor, the construct gB1666 (engineered disulfide by mutating D217C and Y589C) showed a right shift in the in SEC retention volume and a distinct transition temperature at ~73° C. indicating a different conformation from that of the wild type gB (FIGS. 22A and 22B). gB1666 was further characterized by EM imaging experiments. From the cryoEM dataset 2D classification results, prefusion classes were observed as the dominant population and the 3D structure density map confirmed the prefusion gB structure (data not shown). However, in the absence of the inhibitor, the right shifted peak from SEC and the transition temperature peak at ~73° C. are less distinct (FIG. 23). This suggested a single disulfide bond has limited effect to retain gB1666 in a prefusion state.

Thus, a second round of mutations were screened in frame of gB1666 to create further stability of the prefusion conformation in the absence of the inhibitor (Table 11). A new mutant panel was cloned and screened in which a second cysteine pair was introduced into construct pSB1666. The goal was to add another stabilizing disulfide bridge, in order to further stabilize CMV gB in the prefusion state.

TABLE 11

The list of two pairs of disulfide bonds mutants that were screened on full length CMV gB
Full length Prefusion construct pSB1666
Construct Description CMV HAss FLAG/V23 . . . V907 (ACM48044.1)[D217C-Y589C] I675S/Thrombin His6 StrepTagII ** in pcDNA3.1(+).

| Construct name | Mutation 1 | Mutation 2 |
|---|---|---|
| pSB02145 | T100C | N658C |
| pSB02146 | S367C | A500C |
| pSB02147 | D272C | P614C |
| pSB02148 | S219C | F584C |
| pSB02149 | E686V | |
| pSB02191 | D217C | F584C |
| pSB02193 | D217C | N586C |
| pSB02194 | D217C | S588C |
| pSB02195 | S219C | S587C |
| pSB02196 | S219C | S588C |
| pSB02197 | S219C | Y589C |
| pSB02455 | M371C | W506C |
| pSB02456 | F541C | E681C |
| pSB02457 | M371C | W506C |
| pSB02459 | N524C | M684C |

It was determined from this screen that cysteine pair D217C-Y589C, in combination with either pair M371C-W506C (pSB2457) or pair N524C-M684C (pSB2459) stabilized CMV gB in the prefusion state, without the need for a stabilizing inhibitor. gB2457 and gB2459 proteins showed similar profiles in SEC and TM results as the prefusion form (gB1666+ inhibitor) (FIG. 24A-24B). gB2457 had a more distinct transition at ~73° C. in thermal stability assay (FIG. 24B). In addition, both gB2457 and gB2459 showed the prefusion gB feature in the negative staining EM 2D class averaged images (data not shown). In the absence of a fusion inhibitor, gB2457 and gB2459 represent more stable versions of prefusion gB than their parent design, i.e. gB1666. Such improvement also confirms that the right combination of stabilizing mutation sites can synergistically contribute to the overall stability of the prefusion conformation.

In comparison to the full length and membrane bound forms of prefusion gB, a soluble format prefusion gB does not require detergent which provides advantages in scalability of protein production and ease of purification. Based on the known structure, the membrane interaction domains from gB are the membrane proximal region (MPR), the transmembrane (TM) domain and fusion loops. The cytoplasmic tail domain may also interact with membrane from the cytosolic side. Thus, these membrane-interacting hydrophobic regions were either removed or converted to hydrophilic types in the designs for a soluble form prefusion gB. In addition, structurally stable trimerization tags (e.g. GCN4, cysteine rings, trimeric foldon) were added at the carboxy terminal of the protein that truncated at before the MPR domain. Several truncation designs were tested before the GCN4 tag (gB2267) was selected to be used as an ectodomain construct frame. The stabilizing mutation sites identified from full length frame were made on this ectodomain frame and screened (Table 12).

In the resulting gB2555 and gB2556, which were well behaved proteins after purification (FIG. 25A), the phase transition peak at a lower temperature ~73° was not obvious (FIG. 25B). But the 2D classification from negative staining EM images indicated that both prefusion and postfuiosn forms were present (data not shown) and further stabilization were still needed for the ectodomain prefusion gB. The third pair of disulfide bonds were screened on the pSB2556 background (Table 12), but not much improvement was observed.

TABLE 12

Ectodomain CMV gB mutants with triple disulfide bond pairs
Ectodomain construct pSB2556
Construct Description pSB2556: CMV HAss FLAG/V23 . . .
V702 gB CMV (ACM48044)
YIH to GHR (155-157)[D217C-Y589C] [N524C-M684C]
W240A C246S I675S/GCN4 CC tri2 ** in pcDNA3.1(+).

| construct name | mutation 1 | mutation 2 |
| --- | --- | --- |
| pSB2558 | I356C | A500C |
| pSB2559 | S367C | A500C |
| pSB2560 | S367C | A503C |
| pSB2561 | M371C | A505C |
| pSB2562 | M371C | W506C |
| pSB2563 | T374C | A503C |
| pSB2564 | G99C | A267C |
| pSB2565 | T100C | R258C |
| pSB2567 | L603C | Y667C |
| pSB2568 | N605C | K670C |
| pSB2570 | E609C | K691C |
| pSB2571 | T221C | E657C |
| pSB2572 | S223C | T659C |

Since domain V undergoes large conformational changes and was expected to provide the energy to drive the membrane fusion between the viral and host cells, a new approach was to remove Domain V from the ectodomain gB. SB2562 was chosen as the starting construct (Table 13 and Table 14).

TABLE 13

Additional Ectodomain Designs

| | |
| --- | --- |
| pSB2795 | CMV HAss FLAG/V23 . . . D646 gB CMV (ACM48044) YIH to GHR (155-157) D217C W240A C246S M371C N524C W506C Y589C I675S ** in pcDNA3.1(+). |
| pSB2797 | CMV HAss FLAG/V23 . . . V702 gB CMV (ACM48044) YIH to GHR (155-157) 648 MIALDI to GSGKDG D217C W240A C246S M371C N524C W506C Y589C I675S M684C/GCN4 CC tri2 ** in pcDNA3.1(+). |
| pSB2968 | CMV HAss FLAG/V23 . . . V702 gB CMV (ACM48044) PI116117GS YIH to GHR (155-157) 648 MIALDI to GSGKDG D217C W240A C246S M371C N524C W506C Y589C I675S M684C/GCN4 CC tri2 ** in pcDNA3.1(+). |
| A | CMV HAss FLAG/V23 . . . V702 gB CMV (ACM48044) YIH to GHR (155-157) 648 MIALDI to GSGKDG D217C W240A C246S M371C N524C W506C Y589C I675S M684C R693V, last res L695 + KIKQIEDK IEEILSK IYHIENE IARIKKL IG ** in pcDNA3.1(+) |
| B | CMV HAss FLAG/V23 . . . V702 gB CMV (ACM48044) YIH to GHR (155-157) 648 MIALDI to GSGKDG D217C W240A C246S M371C N524C W506C Y589C I675S M684C R685A R693V, last res L695 + KIKQIEDK IEEILSK IYHIENE IARIKKL IG ** in pcDNA3.1(+) |
| C | CMV HAss FLAG/V23 . . . V702 gB CMV (ACM48044) YIH to GHR (155-157) 648 MIALDI to GSGKDG D217C W240A C246S M371C N524C W506C Y589C I675S M684C F678S, L680T R693V, last res L695 + KIKQIEDK IEEILSK IYHIENE IARIKKL IG ** in pcDNA3.1(+) |
| D | CMV HAss FLAG/V23 . . . V702 gB CMV (ACM48044) YIH to GHR (155-157) 648 MIALDI to GSGKDG D217C W240A C246S M371C N524C W506C Y589C I675S M684C P655S R693V, last res L695 + KIKQIEDK IEEILSK IYHIENE IARIKKL IG ** in pcDNA3.1(+) |

One of the designs removed the entire Domain V in which residues after D646 were truncated. Since the disulfide pair could no longer form at N524C and M684C, the N524C was reverted back to its wildtype asparagine residue (N) in order to remove the free cysteine (pSB2796) (Table 14). This construct was named gB2796 and showed a well-behaved protein as a single peak in SEC profile with a distinct phase transition temperature at ~70° C. (FIGS. 26A and 26B). From the cryoEM dataset, 2D class average showed clear expected protein densities that corresponded to the structural features from the model of ectodomain prefusion gB. The 3D reconstructed density envelope also corresponded to the expected ectodomain structure. (data not shown).

TABLE 14

Domain V truncated ectodomain CMV gB mutant with disulfide bond pairs

CMV ectodomain gB prefusion pSB2796
Description   CMV HAss FLAG/V23 . . . D646 gB CMV (ACM48044) YIH to GHR (155-157) [D217C-Y589C] [M371C-W506C]W240A C246S I675S ** in pcDNA3.1(+).

Construct pSB2796 was redesigned into different N-term tagged versions for use in animal studies (Table 15). The Flag tag was swapped out for a 6xHis tag, which is more amenable for purification scale up. An untagged version was also created. The HA signal sequence was also replaced with the IgK signal sequence because it is more compatible with the His tag.

TABLE 15

Construct Design for CMV gB ectodomain prefusion mouse study

| pSB3075 | CMV: IgKss 6xHis rTEV/V23 . . . D646 gB CMV (ACM48044) YIH to GHR (155-157) D217C W240A C246S M371C W506C Y589C I675S ** in pcDNA3.1(+). |
|---|---|
| pSB3076 | CMV: IgKss 6xHis PP/V23 . . . D646 gB CMV (ACM48044) YIH to GHR (155-157) D217C W240A C246S M371C W506C Y589C I675S ** in pcDNA3.1(+). |
| pSB3077 | CMV: IgKss 6xHis/V23 . . . D646 gB CMV (ACM48044) YIH to GHR (155-157) D217C W240A C246S M371C W506C Y589C I675S ** in pcDNA3.1(+). |
| pSB3078 | CMV: IgKss/V23 . . . D646 gB CMV (ACM48044) YIH to GHR (155-157) D217C W240A C246S M371C W506C Y589C I675S ** in pcDNA3.1(+). |

These data showed that the prefusion gB is metastable and stabilizing mutations at multiple sites are needed to achieve enough restraints to maintain its prefusion structure. The combination of disulfide bonds and the modifications of unstable Domain V provide examples of locking the prefusion conformation. The stabilized gB can be engineered in full length (gB1666, gB2457, gB2459) and ectodomain protein formats (gB2796), which are suitable for use as prefusion gB antigens. In addition, the SEC, the thermal shift assay and EM imaging approaches provided ways to evaluate the conformational state of the gB samples without the need for prefusion or postfusion specific antibodies.

Methods

Cysteine Mutants Construct Design and Cloning All constructs were cloned into the pcDNA3.1(+) vector backbone (ThermoFisher Scientific, Waltham, Mass.). Primers, each containing a cysteine point mutation, were ordered from IDT (Coralville, Iowa). Site directed mutagenesis was performed using a QuikChange Multi Site-Directed Mutagenesis Kit (Agilient, Santa Clara, Calif.). The mutagenized DNA was transformed into DH5 alpha cells. Colonies were selected and sent for sequencing. Positive transformants were verified by DNA sequencing analysis. Plasmid DNA was amplified using DNA preparation kits.

Mammalian Cell Expression

EXP1293 cells were grown to an OD of $3\times10^6$ cells/mL. Plasmid DNA was diluted in OptiMem media and mixed 1:1 with PEI solution. The DNA-PEI mixture was then transfected into the EXP1293 cells at a concentration of 1 ug DNA/mL culture. Enhancers were added 24 hours post transfection. Cells were monitored and harvested by centrifugation 4 to 5 days post transfection.

Protein Purification

CMVgB proteins were purified through a series or processes of solubilization, affinity column and size exclusion chromatography (SEC). SEC is run on Superose6 increase column in buffer 25 mM HEPES pH 7.5, 250 mM NaCl, 0.02% DDM, 0.002% CHS. For experiments with inhibitor, 3 ug/ml WAY-174865 was added.

Thermal Stability Assay

As a complementary biophysical study of the gB mutants to help identify prefusion stable mutants, thermal stability of the purified gB proteins was analyzed on Tycho NT.6 with 20° C./min heating rate from 35° C. to 95° C.

Negative Staining Grid Preparation

Thin carbon supported grids were glow discharged by EZ-glow with −20 mA current for 30 seconds before use. Aliquots of 4 ul sample solution at the protein concentration of 0.02 mg/ml were applied to the carbon surface of the grids and let sit for 45 seconds. The sample solution was then blotted away with filter paper and same carbon surface was rinsed with filtered water and excess water was blotted away with filter paper. The grid was stained with 2% uranyl acetate solution and air dried before being loaded to a TF20 electron microscope for imaging.

Cryo Grids Preparations

Quantifoil grids were plasma cleaned with Argon/Oxygen. Graphene oxide stock solution diluted to 0.2 mg/ml concentration (Sigma) was applied to the surface of the treated grid and let sit for 2 minutes. The excess solution was blotted with filter paper and washed with one droplet of water to remove excess graphene oxide. The grid was dried overnight before use. Aliquots of sample solution were vitrified on graphene oxide film-supported grids using a Vitrobot (ThermoFisher). The grids were stored in liquid nitrogen until loaded in the microscope under cryo conditions for imaging.

CryoEM Data Collection, Image Processing

Data collections were done on a Thermo Fisher Titan Krios transmission electron microscope that operates at 300 kV with SerialEM program at a nominal magnification (165,000×) using a K2 direct detector camera (Gatan) with super resolution movie mode. The unbinned pixel size was 0.434 Å, and the beam intensity was ~8e/unbin pixels. The

Example 8: gB2796 Immunogenicity

One of the designed prefusion stabilized ectodomain gB proteins (gB2796) containing amino acids 23-646 with mutations YIH to GHR (155-157), D217C, W240A, C246S, M371C, W506C and Y589C was purified from transfected mammalian via FLAG tag in the absence of fusion inhibitor. Briefly, the protein was purified by adding 20 mM Tris pH 7.5, 200 mM NaCl into the 3L cell media overexpressing SB2796. After incubation with 10 ml of M2 column at 4° C. with rotation for 4 hours, the supernatant was removed and the column was washed thoroughly with PBS. Then the protein was eluted with PBS containing 150 μg/ml FLAG peptide and subsequently concentrated. Size-exclusion chromatography was performed on Superose6 increase 10/300 in PBS at 0.5 ml/min, and the fractions were collected. The purified protein was analyzed on 4-20% Mini-PROTEAN® TGX Stain-Free™ Protein Gels (Biorad) in Tris/glycine/SDS buffer (FIG. 20A) as well as by electronic microscopy with negative staining (FIG. 20B). The EM image showed the triangular shape of the protein particles which is the typical prefusion conformation.

To assess whether gB2796 can elicit a better immune response compared to postfusion gB, a secreted postfusion gB was produced based on the same strain of HCMV with transmembrane domain removed. The protein was named Sanofi gB since it is equivalent to the gB protein used in previous clinical trial by Sanofi (Pass, et al. 2009). Purification of this tagless gB was achieved using affinity chromatography on Lentil Lectin-Sepharose (GE Healthcare) column, followed by anion-exchange chromatography on Toyopearl GigaCap Q-650M (Tosoh), and size-exclusion chromatography on Superdex 200 (GE Healthcare) column.

An in vivo immunogenicity study was conducted in mice with prefusion and postfusion gB described above, as shown in Table 16 below.

TABLE 16

Immunization dose and schedule

| Group | No. of Mice | Immunogen | Adjuvant | Route | Dosing Schedule |
|---|---|---|---|---|---|
| 1 | 10 | gB2796 (4 mcg/0.2 ml) | — | 0.2 ml/SC | Weeks 0, 3, 6 |
| 2 | 10 | gB2796 (1 mcg/0.2 ml) | — | 0.2 ml/SC | Weeks 0, 3, 6 |
| 3 | 10 | gB2796 (0.25 mcg/0.2 ml) | — | 0.2 ml/SC | Weeks 0, 3, 6 |
| 6 | 10 | Sanofi gB (4 mcg/0.2 ml) | — | 0.2 ml/SC | Weeks 0, 3, 6 |
| 7 | 10 | Sanofi gB (1 mcg/0.2 ml) | — | 0.2 ml/SC | Weeks 0, 3, 6 |
| 8 | 10 | Sanofi gB (0.25 mcg/0.2 ml) | — | 0.2 ml/SC | Weeks 0, 3, 6 |

At week 5 (2 weeks after second dose), mice sera samples were analyzed by ELISA to determine the IgG titers against gB2796. The results show dose-dependent IgG responses in both gB2796 and Sanofi gB immunized mice (FIG. 21).

Listing of Raw Sequences

| Construct | Sequence* | SEQ ID NO: |
|---|---|---|
| CMV gB1666: V23..V907 of SEQ ID NO: 1 (Towne) (ACM48044.1) Y589C I675S | VSSSSTRGTSATHSHHSSHTTSAAHSRSGSVSQRVTSSQTVSH GVNETIYNTTLKYGDVVGVNTTKYPYRVCSMAQGTDLIRFER NIVCTSMKPINEDLDEGIMVVYKRNIVAHTFKVRVYQKVLTFR RSYAYIHTTYLLGSNTEYVAPPMWEIHHINSHSQCYSSYSRVIA GTVFVAYHRDSYENKTMQLMPDCYSNTHSTRYVIVKDQWH SRGSTWLYRETCNLNCMVTITTARSKYPYHFFATSTGDVVDIS PFYNGTNRNASYFGENADKFFIFPNYTIVSDFGRPNSALETHRL VAFLERADSVISWDIQDEKNVTCQLTFWEASERTIRSEAEDSY HFSSAKMTATFLSKKQEVNMSDSALDCVRDEAINKLQQIFNT SYNQTYEKYGNVSVFETTGGLVVFWQGIKQKSLVELERLANRS SLNLTHNRTKRSTDGNNATHLSNMESVHNLVYAQLQFTYDTL RGYINRALAQIAEAWCVDQRRTLEVFKELSKINPSAILSAIYNKP IAARFMGDVLGLASCVTINQTSVKVLRDMNVKESPGRCYSRP VVIFNFANSSCVQYGQLGEDNEILLGNHRTEECQLPSLKIFIAG NSAYEYVDYLFKRMIDLSSISTVDSMIALDIDPLENTDFRVLELY SQKELRSSNVFDLEEIMREFNSYKQRVKYVEDKVVDPLPPYLK GLDDLMSGLGAAGKAVGVAIGAVGGAVASVVEGVATFLKNP FGAFTIILVAIAVVIIIYLIYTRQRRLCMQPLQNLFPYLVSADGTT VTSGNTKDTSLQAPPSYEESVYNSGRKGPGPPSSDASTAAPPY TNEQAYQMLLALVRLDAEQRAQQNGTDSLDGQTGTQDKGQ KPNLLDRLRHRKNGYRHLKDSDEEENV | 255 |
| | GTATCCTCCAGCTCTACTAGAGGAACGAGCGCGACCCATTC ACACCACAGCTCCCACACTACGAGCGCTGCCCATTCTAGGA GTGGCTCCGTGTCACAACGCGTTACTAGTAGCCAGACCGTG TCTCACGGCGTCAACGAGACAATTTACAACACGACGCTGAA ATACGGCGATGTCGTGGGTGTGAATACTACCAAGTACCCCT ATAGAGTCTGTAGCATGGCCCAGGGCACCGACCTGATCAG GTTCGAACGGAACATCGTTTGCACATCAATGAAGCCTATCA ACGAAGACCTTGACGAGGGGATTATGGTGGTATACAAACG GAATATCGTGGCTCACACCTTCAAAGTGCGAGTGTATCAGA AGGTTCTGACATTCCGAAGAAGTTACGCCTACATCCATACC ACCTATCTGCTGGGCTCCAACACTGAGTACGTGGCGCCCCC AATGTGGGAAATCCACCACATCAACAGCCATTCACAGTGCT ACTCTTCCTACAGCAGGGTGATTGCGGGCACAGTGTTTGTG GCCTACCACAGGGACAGCTATGAGAACAAGACGATGCAGT TGATGCCAGATTGTTACAGTAACACTCACAGTACACGGTAT | 256 |

Listing of Raw Sequences

| Construct | Sequence* | SEQ ID NO: |
|---|---|---|
| | GTTACAGTTAAGGATCAGTGGCATTCACGCGGAAGCACAT<br>GGCTGTATAGAGAGACCTGTAATTTGAATTGTATGGTAACT<br>ATCACTACTGCACGGAGCAAGTACCCTTATCATTTCTTTGCT<br>ACAAGCACGGGCGATGTGGTAGACATCAGCCCCTTCTATAA<br>TGGCACAAATCGGAACGCAAGCTATTTCGGGGAGAACGCC<br>GACAAGTTTTTCATTTTTCCTAATTATACTATTGTTTCTGACT<br>TCGGGAGACCCAACTCCGCCCTGGAAACTCACAGACTGGTT<br>GCGTTCCTCGAAAGAGCAGATTCTGTGATATCCTGGGACAT<br>TCAGGATGAAAAGAACGTCACGTGTCAGCTGACCTTCTGG<br>GAGGCCTCAGAGCGGACGATCCGGTCTGAGGCCGAGGACT<br>CTTACCACTTTAGCAGCGCCAAGATGACCGCAACCTTCCTG<br>TCTAAAAAACAGGAAGTGAACATGTCCGATTCTGCTTTGGA<br>CTGCGTTCGCGATGAGGCCATCAACAAGCTTCAACAAATTT<br>TCAATACCTCCTACAATCAGACATATGAAAAATACGGAAAC<br>GTGAGTGTCTTTGAAACCACCGGGGGCCTGGTCGTGTTCTG<br>GCAGGGTATCAAACAGAAGAGCCTGGTGGAACTGGAACG<br>CCTGGCCAACAGAAGCAGTTTGAACCTCACGCACAACCGG<br>ACAAAGAGGAGCACCGACGGAAACAATGCTACACACCTTT<br>CCAACATGGAGTCTGTCCACAATCTGGTTTATGCACAGCTT<br>CAGTTCACTTATGACACACTGCGGGGCTACATAAACAGGGC<br>TCTGGCACAGATAGCCGAGGCTTGGTGTGTGGACCAGCGG<br>AGAACCCTGGAGGTATTTAAAGAACTGTCTAAGATCAACCC<br>CTCTGCGATTCTGAGCGCTATTTACAACAAACCCATTGCCGC<br>ACGCTTCATGGGGGACGTCCTCGGTCTTGCCTCCTGTGTGA<br>CAATTAACCAGACGAGCGTGAAGGTGCTGCGAGATATGAA<br>CGTGAAGGAATCCCCTGGGCGGTGTTACAGTAGGCCTGTG<br>GTGATTTTCAACTTCGCCAACTCTTCCTGTGTCCAATACGGT<br>CAACTCGGTGAAGATAACGAGATTCTGCTGGGCAATCATC<br>GGACAGAAGAATGCCAGTTGCCAAGCCTTAAAATCTTTATT<br>GCAGGAAATTCAGCCTACGAGTACGTCGACTATCTGTTTAA<br>AAGAATGATTGATCTGAGCAGCATTTCCACTGTGGACAGTA<br>TGATCGCACTGGACATTGACCCTTTGGAAAACACCGATTTT<br>CGCGTCCTTGAGCTGTACTCCCAGAAAGAACTGCGCTCTAG<br>CAACGTCTTTGATCTTGAGGAGATCATGAGGGAGTTTAACT<br>CTTATAAACAGAGGGTGAAGTATGTGGAGGATAAAGTGGT<br>CGACCCTCTGCCACCCTACCTCAAAGGACTGGACGATCTGA<br>TGAGCGGACTTGGAGCTGCCGGCAAAGCCGTCGGGGTGG<br>CTATCGGTGCCGTGGGCGGCGCCGTGGCTTCTGTGGTTGA<br>GGGAGTGGCCACTTTTCTTAAAAATCCTTTCGGAGCTTTTAC<br>CATTATTCTGGTCGCCATCGCCGTGGTGATCATCATTTATCT<br>GATCTACACCCGCCAGCGCCGCTTGTGCATGCAGCCACTTC<br>AGAACCTGTTTCCCTATCTGGTCAGTGCTGACGGTACAACC<br>GTGACCAGCGGCAACACAAAGGACACAAGCCTTCAGGCTC<br>CTCCAAGTTATGAAGAGTCCGTGTATAATTCTGGGAGGAA<br>GGGACCTGGTCCCCCCTCTTCCGACGCCTCAACAGCGGCAC<br>CCCCCTACACCAATGAGCAGGCATATCAGATGCTCCTGGCC<br>CTTGTGCGGCTCGATGCCGAGCAACGCGCACAACAGAACG<br>GGACGGATTCTCTCGACGGACAGACAGGCACTCAGGACAA<br>AGGCCAGAAGCCCAACCTTCTGGATCGGTTGCGGCATAGA<br>AAAAACGGCTATAGACACCTCAAGGACTCAGACGAAGAAG<br>AGAACGTC | |
| CMV gB2457 (Prefusion, Full length) V23 to V907 of SEQ ID NO: 1 (Towne) M371C W506C Y589C I675S | VSSSSTRGTSATHSHHSSHTTSAAHSRSGSVSQRVTSSQTVSH<br>GVNETIYNTTLKYGDVVGVNTTKYPYRVCSMAQGTDLIRFER<br>NIVCTSMKPINEDLDEGIMVVYKRNIVAHTFKVRVYQKVLTFR<br>RSYAYIHTTYLLGSNTEYVAPPMWEIHHINSHSQCYSSYSRVIA<br>GTVFVAYHRDSYENKTMQLMPD<u>C</u>YSNTHSTRYVIVKDQWH<br>SRGSTWLYRETCNLNCMVTITTA<u>R</u>SKYPYHFFATSTGDVVDIS<br>PFYNGTNRNASYFGENADKFFIFPNYTIVSDFGRPNSALETHRL<br>VAFLERADSVISWDIQDEKNVTCQLTFWEASERTIRSEAEDSY<br>HFSSAKCTATFLSKKQEVNMSDSALDCVRDEAINKLQQIFNTS<br>YNQTYEKYGNVSVFETTGGLVVFWQGIKQKSLVELERLANRSS<br>LNLTHNRTKRSTDGNNATHLSNMESVHNLVYAQLQFTYDTLR<br>GYINRALAQIAEACCVDQRRTLEVFKELSKINPSAILSAIYNKPIA<br>ARFMGDVLGLASCVTINQTSVKVLRDMNVKESPGRCYSRPVV<br>IFNFANSSCVQYGQLGEDNEILLGNHRTEECQLPSLKIFIAGNS<br>AYEYVDYLFKRMIDLSSISTVDSMIALDIDPLENTDFRVLELYSQ<br>KELRSSNVFDLEEIMREFNSYKQRVKYVEDKVVDPLPPYLKGL<br>DDLMSGLGAAGKAVGVAIGAVGGAVASVVEGVATFLKNPFG<br>APTIILVAIAVVIIIYLIYTRQRRLCMQPLQNLFPYLVSADGTTVT<br>SGNTKDTSLQAPPSYEESVYNSGRKGPGPPSSDASTAAPPYTN<br>EQAYQMLLAVLRLDAEQRAQQNGTDSLDGQTGTQDKGQKP<br>NLLDRLRHRKNGYRHLKDSDEEENV | 257 |

-continued

| Construct | Sequence* | SEQ ID NO: |
|---|---|---|
| | GTATCCTCCAGCTCTACTAGAGGAACGAGCGCGACCCATTC<br>ACACCACAGCTCCCACACTACGAGCGCTGCCCATTCTAGGA<br>GTGGCTCCGTGTCACAACGCGTTACTAGTAGCCAGACCGTG<br>TCTCACGGCGTCAACGAGACAATTTACAACGACGCTGAA<br>ATACGGCGATGTCGTGGGTGTGAATACTACCAAGTACCCT<br>ATAGAGTCTGTAGCATGGCCCAGGGCACCGACCTGATCAG<br>GTTCGAACGGAACATCGTTTGCACATCAATGAAGCCTATCA<br>ACGAAGACCTTGACGAGGGGATTATGGTGGTATACAAACG<br>GAATATCGTGGCTCACACCTTCAAAGTGCGAGTGTATCAGA<br>AGGTTCTGACATTCCGAAGAAGTTACGCCTACATCCATACC<br>ACCTATCTGCTGGGCTCCAACACTGAGTACGTGGCGCCCC<br>AATGTGGGAAATCCACCACATCAACAGCCATTCACAGTGCT<br>ACTCTTCCTACAGCAGGGTGATTGCGGGCACAGTGTTTGTG<br>GCCTACCACAGGGACAGCTATGAGAACAAGACGATGCAGT<br>TGATGCCAGATTGTTACAGTAACACTCACAGTACACGGTAT<br>GTTACAGTTAAGGATCAGTGGCATTCACGCGGAAGCACAT<br>GGCTGTATAGAGAGACCTGTAATTTGAATTGTATGGTAACT<br>ATCACTACTGCACGGAGCAAGTACCCTTATCATTTCTTTGCT<br>ACAAGCACGGGCGATGTGGTAGACATCAGCCCCTTCTATAA<br>TGGCACAAATCGGAACGCAAGCTATTTCGGGGAGAACGCC<br>GACAAGTTTTTCATTTTTCCTAATTATACTATTGTTTCTGACT<br>TCGGGAGACCCAACTCCGCCCTGGAAACTCACAGACTGGTT<br>GCGTTCCTCGAAAGAGCAGATTCTGTGATATCCTGGGACAT<br>TCAGGATGAAAAGAACGTCACGTGTCAGCTGACCTTCTGG<br>GAGGCCTCAGAGCGGACGATCCGGTCTGAGGCCGAGGACT<br>CTTACCACTTTAGCAGCGCCAAGTGCACCGCAACCTTCCTGT<br>CTAAAAAACAGGAAGTGAACATGTCCGATTCTGCTTTGGAC<br>TGCGTTCGCGATGAGGCCATCAACAAGCTTCAACAAATTTT<br>CAATACCTCCTACAATCAGACATATGAAAAATACGGAAACG<br>TGAGTGTCTTTGAAACCACCGGGGGCCTGGTCGTGTTCTGG<br>CAGGGTATCAAACAGAAGAGCCTGGTGGAACTGGAACGCC<br>TGGCCAACAGAAGCAGTTTGAACCTCACGCACAACCGGAC<br>AAAGAGGAGCACCGACGGAAACAATGCTACACACCTTTCC<br>AACATGGAGTCTGTCCACAATCTGGTTTATGCACAGCTTCA<br>GTTCACTTATGACACACTGCGGGGCTACATAAACAGGGCTC<br>TGGCACAGATAGCCGAGGCTTGCTGTGTGGACCAGCGGAG<br>AACCCTGGAGGTATTTAAAGAACTGTCTAAGATCAACCCCT<br>CTGCGATTCTGAGCGCTATTTACAACAAACCCATTGCCGCA<br>CGCTTCATGGGGGACGTCCTCGGTCTTGCCTCCTGTGTGAC<br>AATTAACCAGACGAGCGTGAAGGTGCTGCGAGATATGAAC<br>GTGAAGGAATCCCCTGGGCGGTGTTACAGTAGGCCTGTGG<br>TGATTTTCAACTTCGCCAACTCTTCCTGTGTCCAATACGGTC<br>AACTCGGTGAAGATAACGAGATTCTGCTGGGCAATCATCG<br>GACAGAAGAATGCCAGTTGCCAAGCCTTAAAATCTTTATTG<br>CAGGAAATTCAGCCTACGAGTACGTCGACTATCTGTTTAAA<br>AGAATGATTGATCTGAGCAGCATTTCCACTGTGGACAGTAT<br>GATCGCACTGGACATTGACCCTTTGGAAAACACCGATTTTC<br>GCGTCCTTGAGCTGTACTCCCAGAAAGAACTGCGCTCTAGC<br>AACGTCTTTGATCTTGAGGAGATCATGAGGGAGTTTAACTC<br>TTATAAACAGAGGGTGAAGTATGTGGAGGATAAAGTGGTC<br>GACCCTCTGCCACCCTACCTCAAAGGACTGGACGATCTGAT<br>GAGCGGACTTGGAGCTGCCGGCAAAGCCGTCGGGGTGGC<br>TATCGGTGCCGTGGGCGGCGCCGTGGCTTCTGTGGTTGAG<br>GGAGTGGCCACTTTTCTTAAAAATCCTTTCGGAGCTTTTACC<br>ATTATTCTGGTCGCCATCGCCGTGGTGATCATCATTTATCTG<br>ATCTACACCCGCCAGCGCCGCTTGTGCATGCAGCCACTTCA<br>GAACCTGTTTCCCTATCTGGTCAGTGCTGACGGTACAACCG<br>TGACCAGCGGCAACACAAAGGACACAAGCCTTCAGGCTCC<br>TCCAAGTTATGAAGAGTCCGTGTATAATTCTGGGAGGAAG<br>GGACCTGGTCCCCCCTCTTCCGACGCCTCAACAGCGGCACC<br>CCCTACACCAATGAGCAGGCATATCAGATGCTCCTGGCCC<br>TTGTGCGGCTCGATGCCGAGCAACGCGCACAACAGAACGG<br>GACGGATTCTCTCGACGGACAGACAGGCACTCAGGACAAA<br>GGCCAGAAGCCCAACCTTCTGGATCGGTTGCGGCATAGAA<br>AAAACGGCTATAGACACCTCAAGGACTCAGACGAAGAAGA<br>GAACGTC | 258 |
| CMV gB2459 (Prefusion, Full length) V23 to V907 of SEQ ID NO: 1 (Towne) N524C Y589C M684C I675S | VSSSSTRGTSATHSHHSSHTTSAAHSRSGSVSQRVTSSQTVSH<br>GVNETIYNTTLKYGDVVGVNTTKYPYRVCSMAQGTDLIRFER<br>NIVCTSMKPINEDLDEGIMVVYKRNIVAHTFKVRVYQKVLTFR<br>RSYAYIHTTYLLGSNTEYVAPPMWEIHHINSHSQCYSSYSRVIA<br>GTVFVAYHRDSYENKTMQLMPDCYSNTHSTRYVTVKDQWH<br>SRGSTWLYRETCNLNCMVTITTARSKYPYHFFATSTGDVVDIS<br>PFYNGTNRNASYFGENADKFFIFPNYTIVSDFGRPNSALETHRL | 259 |

-continued

Listing of Raw Sequences

| Construct | Sequence* | SEQ ID NO: |
|---|---|---|
| | VAFLERADSVISWDIQDEKNVTCQLTFWEASERTIRSEAEDSY HFSSAKMTATFLSKKQEVNMSDSALDCVRDEAINKLQQIFNT SYNQTYEKYGNVSVFETTGGLVVFWQGIKQKSLVELERLANRS SLNLTHNRTKRSTDGNNATHLSNMESVHNLVYAQLQFTYDTL RGYINRALAQIAEAWCVDQRRTLEVFKELSKICPSAILSAIYNKP IAARFMGDVLGLASCVTINQTSVKVLRDMNVKESPGRCYSRP VVIFNFANSSCVQYGQLGEDNEILLGNHRTEECQLPSLKIFIAG NSAYEYVDYLFKRMIDLSSISTVDSMIALDIDPLENTDFRVLELY SQKELRSSNVFDLEEICREFNSYKQRVKYVEDKVVDPLPPYLKG LDDLMSGLGAAGKAVGVAIGAVGGAVASVVEGVATFLKNPF GAFTIILVAIAVVIIIYLIYTRQRRLCMQPLQNLFPYLVSADGTTV TSGNTKDTSLQAPPSYEESVYNSGRKGPGPPSSDASTAAPPYT NEQAYQMLLALVRLDAEQRAQQNGTDSLDGQTGTQDKGQK PNLLDRLRHRKNGYRHLKDSDEEENV | |
| | GTATCCTCCAGCTCTACTAGAGGAACGAGCGCGACCCATTC ACACCACAGCTCCCACACTACGAGCGCTGCCCATTCTAGGA GTGGCTCCGTGTCACAACGCGTTACTAGTAGCCAGACCGTG TCTCACGGCGTCAACGAGACAATTTACAACACGACGCTGAA ATACGGCGATGTCGTGGGTGTGAATACTACCAAGTACCCCT ATAGAGTCTGTAGCATGGCCCAGGGCACCGACCTGATCAG GTTCGAACGGAACATCGTTTGCACATCAATGAAGCCTATCA ACGAAGACCTTGACGAGGGGATTATGGTGGTATACAAACG GAATATCGTGGCTCACACCTTCAAAGTGCGAGTGTATCAGA AGGTTCTGACATTCCGAAGAAGTTACGCCTACATCCATACC ACCTATCTGCTGGGCTCCAACACTGAGTACGTGGCGCCCCC AATGTGGGAAATCCACCACATCAACAGCCATTCACAGTGCT ACTCTTCCTACAGCAGGGTGATTGCGGGCACAGTGTTTGTG GCCTACCACAGGGACAGCTATGAGAACAAGACGATGCAGT TGATGCCAGATTGTTACAGTAACACTCACAGTACACGGTAT GTTACAGTTAAGGATCAGTGGCATTCACGCGGAAGCACAT GGCTGTATAGAGAGACCTGTAATTTGAATTGTATGGTAACT ATCACTACTGCACGGAGCAAGTACCCTTATCATTTCTTTGCT ACAAGCACGGGCGATGTGGTAGACATCAGCCCCTTCTATAA TGGCACAAATCGGAACGCAAGCTATTTCGGGGAGAACGCC GACAAGTTTTTCATTTTTCCTAATTATACTATTGTTTCTGACT TCGGGAGACCCAACTCCGCCCTGGAAACTCACAGACTGGTT GCGTTCCTCGAAAGAGCAGATTCTGTGATATCCTGGGACAT TCAGGATGAAAAGAACGTCACGTGTCAGCTGACCTTCTGG GAGGCCTCAGAGCGGACGATCCGGTCTGAGGCCGAGGACT CTTACCACTTTAGCAGCGCCAAGATGACCGCAACCTTCCTG TCTAAAAAACAGGAAGTGAACATGTCCGATTCTGCTTTGGA CTGCGTTCGCGATGAGGCCATCAACAAGCTTCAACAAATTT TCAATACCTCCTACAATCAGACATATGAAAAATACGGAAAC GTGAGTGTCTTTGAAACCACCGGGGGCCTGGTCGTGTTCTG GCAGGGTATCAAACAGAAGAGCCTGGTGGAACTGGAACG CCTGGCCAACAGAAGCAGTTTGAACCTCACGCACAACCGG ACAAAGAGGAGCACCGACGGAAACAATGCTACACACCTTT CCAACATGGAGTCTGTCCACAATCTGGTTTATGCACAGCTT CAGTTCACTTATGACACACTGCGGGGCTACATAAACAGGGC TCTGGCACAGATAGCCGAGGCTTGGTGTGTGGACCAGCGG AGAACCCTGGAGGTATTTAAAGAACTGTCTAAGATCTGTCC CTCTGCGATTCTGAGCGCTATTTACAACAAACCCATTGCCGC ACGCTTCATGGGGGACGTCCTCGGTCTTGCCTCCTGTGTGA CAATTAACCAGACGAGCGTGAAGGTGCTGCGAGATATGAA CGTGAAGGAATCCCCTGGGCGGTGTTACAGTAGGCCTGTG GTGATTTTCAACTTCGCCAACTCTTCCTGTGTCCAATACGGT CAACTCGGTGAAGATAACGAGATTCTGCTGGGCAATCATC GGACAGAAGAATGCCAGTTGCCAAGCCTTAAAATCTTTATT GCAGGAAATTCAGCCTACGAGTACGTCGACTATCTGTTTAA AAGAATGATTGATCTGAGCAGCATTTCCACTGTGGACAGTA TGATCGCACTGGACATTGACCCTTTGGAAAACACCGATTTT CGCGTCCTTGAGCTGTACTCCCAGAAAGAACTGCGCTCTAG CAACGTCTTTGATCTTGAGGAGATCGTAGGGAGTTTAACT CTTATAAACAGAGGGTGAAGTATGTGGAGGATAAAGTGGT CGACCCTCTGCCACCCTACCTCAAAGGACTGGACGATCTGA TGAGCGGACTTGGAGCTGCCGGCAAAGCCGTCGGGGTGG CTATCGGTGCCGTGGGCGGCGCCGTGGCTTCTGTGGTTGA GGGAGTGGCCACTTTTCTTAAAAATCCTTTCGGAGCTTTTAC CATTATTCTGGTCGCCATCGCCGTGGTGATCATCATTTATCT GATCTACACCCGCCAGCGCCGCTTGTGCATGCAGCCACTTC AGAACCTGTTTCCCTATCTGGTCAGTGCTGACGGTACAACC GTGACCAGCGGCAACACAAAGGACACAAGCCTTCAGGCTC CTCCAAGTTATGAAGAGTCCGTGTATAATTCTGGGAGGAA GGGACCTGGTCCCCCCTCTTCCGACGCCTCAACAGCGGCAC | 260 |

-continued

Listing of Raw Sequences

| Construct | Sequence* | SEQ ID NO: |
|---|---|---|
| | CCCCCTACACCAATGAGCAGGCATATCAGATGCTCCTGGCC CTTGTGCGGCTCGATGCCGAGCAACGCGCACAACAGAACG GGACGGATTCTCTCGACGGACAGACAGGCACTCAGGACAA AGGCCAGAAGCCCAACCTTCTGGATCGGTTGCGGCATAGA AAAAACGGCTATAGACACCTCAAGGACTCAGACGAAGAAG AGAACGTC | |
| CMV gB2555: V23..V702 gB CMV (ACM48044) of SEQ ID NO: 1 (Towne) including trimerization domain (GCN4 CC tri2) [YIH to GHR (155-157) D217C W240A M371C C246S W506C Y589C I675S/GCN4 CC tri2] | VSSSSTRGTSATHSHHSSHTTSAAHSRSGSVSQRVTSSQTVSH GVNETIYNTTLKYGDVVGVNTTKYPYRVCSMAQGTDLIRFER NIVCTSMKPINEDLDEGIMVVYKRNIVAHTFKVRVYQKVLTFR RSYAGHRTTYLLGSNTEYVAPPMWEIHHINSHSQCYSSYSRVI AGTVFVAYHRDSYENKTMQLMPDCYSNTHSTRYVTVKDQW HSRGSTALYRETSNLNCMVTITTARSKYPYHFFATSTGDVVDIS PFYNGTNRNASYFGENADKFFIFPNYTIVSDFGRPNSALETHRL VAFLERADSVISWDIQDEKNVTCQLTFWEASERTIRSEAEDSY HFSSAKCTATFLSKKQEVNMSDSALDCVRDEAINKLQQIFNTS YNQTYEKYGNVSVFETTGGLVVFWQGIKQKSLVELERLANRSS LNLTHNRTKRSTDGNNATHLSNMESVHNLVYAQLQFTYDTLR GYINRALAQIAEACCVDQRRTLEVFKELSKINPSAILSAIYNKPIA ARFMGDVLGLASCVTINQTSVKVLRDMNVKESPGRCYSRPVV IFNFANSSCVQYGQLGEDNEILLGNHRTEECQLPSLKIFIAGNS AYEYVDYLFKRMIDLSSISTVDSMIALDIDPLENTDFRVLELYSQ KELRSSNVFDLEEIMREFNSYKQRVKYVEDKVVKIEEILSKQYHI ENEIARIKKLIG | 261 |
| | GTATCCTCCAGCTCTACTAGAGGAACGAGCGCGACCCATTC ACACCACAGCTCCCACACTACGAGCGCTGCCCATTCTAGGA GTGGCTCCGTGTCACAACGCGTTACTAGTAGCCAGACCGTG TCTCACGGCGTCAACGAGACAATTTACAACACGACGCTGAA ATACGGCGATGTCGTGGGTGTGAATACTACCAAGTACCCCT ATAGAGTCTGTAGCATGGCCCAGGGCACCGACCTGATCAG GTTCGAACGGAACATCGTTTGCACATCAATGAAGCCTATCA ACGAAGACCTTGACGAGGGGATTATGGTGGTATACAAACG GAATATCGTGGCTCACACCTTCAAAGTGCGAGTGTATCAGA AGGTTCTGACATTCCGAAGAAGTTACGCCGGTCATCGTACC ACCTATCTGCTGGGCTCCAACACTGAGTACGTGGCGCCCCC AATGTGGGAAATCCACCACATCAACAGCCATTCACAGTGCT ACTCTTCCTACAGCAGGGTGATTGCGGGCACAGTGTTTGTG GCCTACCACAGGGACAGCTATGAGAACAAGACGATGCAGT TGATGCCAGATTGTTACAGTAACACTCACAGTACACGGTAT GTTACAGTTAAGGATCAGTGGCATTCACGCGGAAGCACAG CACTGTATAGAGAGACCTCTAATTTGAATTGTATGGTAACT ATCACTACTGCACGGAGCAAGTACCCTTATCATTTCTTTGCT ACAAGCACGGGCGATGTGGTAGACATCAGCCCCTTCTATAA TGGCACAAATCGGAACGCAAGCTATTTCGGGGAGAACGCC GACAAGTTTTTCATTTTTCCTAATTATACTATTGTTTCTGACT TCGGGAGACCCAACTCCGCCCTGGAAACTCACAGACTGGTT GCGTTCCTCGAAAGAGCAGATTCTGTGATATCCTGGGACAT TCAGGATGAAAAGAACGTCACGTGTCAGCTGACCTTCTGG GAGGCCTCAGAGCGGACGATCCGGTCTGAGGCCGAGGACT CTTACCACTTTAGCAGCGCCAAGTGCACCGCAACCTTCCTGT CTAAAAAACAGGAAGTGAACATGTCCGATTCTGCTTTGGAC TGCGTTCGCGATGAGGCCATCAACAAGCTTCAACAAATTTT CAATACCTCCTACAATCAGACATATGAAAAATACGGAAACG TGAGTGTCTTTGAAACCACCGGGGGCCTGGTCGTGTTCTGG CAGGGTATCAAACAGAAGAGCCTGGTGGAACTGGAACGCC TGGCCAACAGAAGCAGTTTGAACCTCACGCACAACCGGAC AAAGAGGAGCACCGACGGAAACAATGCTACACACCTTTCC AACATGGAGTCTGTCCACAATCTGGTTTATGCACAGCTTCA GTTCACTTATGACACACTGCGGGGCTACATAAACAGGGCTC TGGCACAGATAGCCGAGGCTTGCTGTGTGGACCAGCGGAG AACCCTGGAGGTATTTAAAGAACTGTCTAAGATCAACCCCT CTGCGATTCTGAGCGCTATTTACAACAAACCCATTGCCGCA CGCTTCATGGGGGACGTCCTCGGTCTTGCCTCCTGTGTGAC AATTAACCAGACGAGCGTGAAGGTGCTGCGAGATATGAAC GTGAAGGAATCCCCTGGGCGGTGTTACAGTAGGCCTGTGG TGATTTTCAACTTCGCCAACTCTTCCTGTGTCCAATACGGTC AACTCGGTGAAGATAACGAGATTCTGCTGGGCAATCATCG GACAGAAGAATGCCAGTTGCCAAGCCTTAAAATCTTTATTG CAGGAAATTCAGCCTACGAGTACGTCGACTATCTGTTTAAA AGAATGATTGATCTGAGCAGCATTTCCACTGTGGACAGTAT GATCGCACTGGACATTGACCCTTTGGAAAACACCGATTTTC GCGTCCTTGAGCTGTACTCCCAGAAAGAACTGCGCTCTAGC AACGTCTTTGATCTTGAGGAGATCATGAGGGAGTTTAACTC TTATAAACAGAGGGTGAAGTATGTGGAGGATAAAGTGGTC | 262 |

Listing of Raw Sequences

| Construct | Sequence* | SEQ ID NO: |
|---|---|---|
| | AAGATCGAGGAGATCCTGTCCAAGCAGTACCACATCGAG AACGAGATCGCCCGCATCAAGAAGCTGATCGGC | |
| CMV gB2556: V23..V702 gB CMV (ACM48044) of SEQ ID NO: 1 (Towne) including trimerization domain (GCN4 CC tri2) [YIH to GHR (155-157) D217C W240A C246S N524C Y589C I675S M684C/GCN4 CC tri2] | VSSSSTRGTSATHSHHSSHTTSAAHSRSGSVSQRVTSSQTVSH GVNETIYNTTLKYGDVVGVNTTKYPYRVCSMAQGTDLIRFER NIVCTSMKPINEDLDEGIMVVYKRNIVAHTFKVRVYQKVLTFR RSYAGHRTTYLLGSNTEYVAPPMWEIHHINSHSQCYSSYSRVI AGTVFVAYHRDSYENKTMQLMPDCYSNTHSTRYVTVKDQW HSRGSTALYRETSNLNCMVTITTARSKYPYHFFATSTGDVVDIS PFYNGTNRNASYFGENADKFFIFPNYTIVSDFGRPNSALETHRL VAFLERADSVISWDIQDEKNVTCQLTFWEASERTIRSEAEDSY HFSSAKMTATFLSKKQEVNMSDSALDCVRDEAINKLQQIFNT SYNQTYEKYGNVSVFETTGGLVVFWQGIKQKSLVELERLANRS SLNLTHNRTKRSTDGNNATHLSNMESVHNLVYAQLQFTYDTL RGYINRALAQIAEAWCVDQRRTLEVFKELSKICPSAILSAIYNKP IAARFMGDVLGLASCVTINQTSVKVLRDMNVKESPGRCYSRP VVIFNFANSSCVQYGQLGEDNEILLGNHRTEECQLPSLKIFIAG NSAYEYVDYLFKRMIDLSSISTVDSMIALDIDPLENTDFRVLELY SQKELRSSNVFDLEEICREFNSYKQRVKYVEDKVVKIEEILSKQY HIENEIARIKKLIG | 263 |
| | GTATCCTCCAGCTCTACTAGAGGAACGAGCGCGACCCATTC ACACCACAGCTCCCACACTACGAGCGCTGCCCATTCTAGGA GTGGCTCCGTGTCACAACGCGTTACTAGTAGCCAGACCGTG TCTCACGGCGTCAACGAGACAATTTACAACACGACGCTGAA ATACGGCGATGTCGTGGGTGTGAATACTACCAAGTACCCCT ATAGAGTCTGTAGCATGGCCCAGGGCACCGACCTGATCAG GTTCGAACGGAACATCGTTTGCACATCAATGAAGCCTATCA ACGAAGACCTTGACGAGGGGATTATGGTGGTATACAAACG GAATATCGTGGCTCACACCTTCAAAGTGCGAGTGTATCAGA AGGTTCTGACATTCCGAAGAAGTTACGCCGGTCATCGTACC ACCTATCTGCTGGGCTCCAACACTGAGTACGTGGCGCCCCC AATGTGGGAAATCCACCACATCAACAGCCATTCACAGTGCT ACTCTTCCTACAGCAGGGTGATTGCGGGCACAGTGTTTGTG GCCTACCACAGGGACAGCTATGAGAACAAGACGATGCAGT TGATGCCAGATTGTTACAGTAACACTCACAGTACACGGTAT GTTACAGTTAAGGATCAGTGGCATTCACGCGGAAGCACAG CACTGTATAGAGAGACCTCTAATTTGAATTGTATGGTAACT ATCACTACTGCACGGAGCAAGTACCCTTATCATTTCTTTGCT ACAAGCACGGGCGATGTGGTAGACATCAGCCCCTTCTATAA TGGCACAAATCGGAACGCAAGCTATTTCGGGGAGAACGCC GACAAGTTTTTCATTTTTCCTAATTATACTATTGTTTCTGACT TCGGGAGACCCAACTCCGCCCTGGAAACTCACAGACTGGTT GCGTTCCTCGAAAGAGCAGATTCTGTGATATCCTGGGACAT TCAGGATGAAAAGAACGTCACGTGTCAGCTGACCTTCTGG GAGGCCTCAGAGCGGACGATCCGGTCTGAGGCCGAGGACT CTTACCACTTTAGCAGCGCCAAGATGACCGCAACCTTCCTG TCTAAAAAACAGGAAGTGAACATGTCCGATTCTGCTTTGGA CTGCGTTCGCGATGAGGCCATCAACAAGCTTCAACAAATTT TCAATACCTCCTACAATCAGACATATGAAAAATACGGAAAC GTGAGTGTCTTTGAAACCACCGGGGGCCTGGTCGTGTTCTG GCAGGGTATCAAACAGAAGAGCCTGGTGGAACTGGAACG CCTGGCCAACAGAAGCAGTTTGAACCTCACGCACAACCGG ACAAAGAGGAGCACCGACGGAAACAATGCTACACACCTTT CCAACATGGAGTCTGTCCACAATCTGGTTTATGCACAGCTT CAGTTCACTTATGACACACTGCGGGGCTACATAAACAGGGC TCTGGCACAGATAGCCGAGGCTTGGTGTGTGGACCAGCGG AGAACCCTGGAGGTATTTAAAGAACTGTCTAAGATCTGTCC CTCTGCGATTCTGAGCGCTATTTACAACAAACCCATTGCCGC ACGCTTCATGGGGGACGTCCTCGGTCTTGCCTCCTGTGTGA CAATTAACCAGACGAGCGTGAAGGTGCTGCGAGATATGAA CGTGAAGGAATCCCCTGGGCGTGTTACAGTAGGCCTGTG GTGATTTTCAACTTCGCCAACTCTTCCTGTGTCCAATACGGT CAACTCGGTGAAGATAACGAGATTCTGCTGGGCAATCATC GGACAGAAGAATGCCAGTTGCCAAGCCTTAAAATCTTTATT GCAGGAAATTCAGCCTACGAGTACGTCGACTATCGTTTAA AAGAATGATTGATCTGAGCAGCATTTCCACTGTGGACAGTA TGATCGCACTGGACATTGACCCTTTGGAAAAACACCGATTTT CGCGTCCTTGAGCTGTACTCCCAGAAAGAACTGCGCTCTAG CAACGTCTTTGATCTTGAGGAGATCTGTAGGGAGTTTAACT CTTATAAACAGAGGGTGAAGTATGTGGAGGATAAAGTGGT CAAGATCGAGGAGATCCTGTCCAAGCAGTACCACATCGA GAACGAGATCGCCCGCATCAAGAAGCTGATCGGC | 264 |

-continued

Listing of Raw Sequences

| Construct | Sequence* | SEQ ID NO: |
|---|---|---|
| CMV gB2796 (Prefusion, ectodomain) V23 to D646 of SEQ ID NO: 1 (Towne) [YIH to GHR (155-157) D217C W240A C246S M371C W506C Y589C] | VSSSSTRGTSATHSHHSSHTTSAAHSRSGSVSQRVTSSQTVSH GVNETIYNTTLKYGDVVGVNTTKYPYRVCSMAQGTDLIRFER NIVCTSMKPINEDLDEGIMVVYKRNIVAHTFKVRVYQKVLTFR RSYAGHRTTYLLGSNTEYVAPPMWEIHHINSHSQCYSSYSRVI AGTVFVAYHRDSYENKTMQLMPDCYSNTHSTRYVTVKDQW HSRGSTALYRETSNLNCMVTITTARSKYPYHFFATSTGDVVDIS PFYNGTNRNASYFGENADKFFIFPNYTIVSDFGRPNSALETHRL VAFLERADSVISWDIQDEKNVTCQLTFWEASERTIRSEAEDSY HFSSAKCTATFLSKKQEVNMSDSALDCVRDEAINKLQQIFNTS YNQTYEKYGNVSVFETTGGLVVFWQGIKQKSLVELERLANRSS LNLTHNRTKRSTDGNNATHLSNMESVHNLVYAQLQFTYDTLR GYINRALAQIAEACCVDQRRTLEVFKELSKINPSAILSAIYNKPIA ARFMGDVLGLASCVTINQTSVKVLRDMNVKESPGRCYSRPVV IFNFANSSCVQYGQLGEDNE1LLGNHRTEECQLPSLKIFIAGNS AYEYVDYLFKRMIDLSSISTVD | 265 |
| | GTATCCTCCAGCTCTACTAGAGGAACGAGCGCGACCCATTC ACACCACAGCTCCCACACTACGAGCGCTGCCCATTCTAGGA GTGGCTCCGTGTCACAACGCGTTACTAGTAGCCAGACCGTG TCTCACGGCGTCAACGAGACAATTTACAACACGACGCTGAA ATACGGCGATGTCGTGGGTGTGAATACTACCAAGTACCCCT ATAGAGTCTGTAGCATGGCCCAGGGCACCGACCTGATCAG GTTCGAACGGAACATCGTTTGCACATCAATGAAGCCTATCA ACGAAGACCTTGACGAGGGGATTATGGTGGTATACAAACG GAATATCGTGGCTCACACCTTCAAAGTGCGAGTGTATCAGA AGGTTCTGACATTCCGAAGAAGTTACGCCGGTCATCGTACC ACCTATCTGCTGGGCTCCAACACTGAGTACGTGGCGCCCCC AATGTGGGAAATCCACCACATCAACAGCCATTCACAGTGCT ACTCTTCCTACAGCAGGGTGATTGCGGGCACAGTGTTTGTG GCCTACCACAGGGACAGCTATGAGAACAAGACGATGCAGT TGATGCCAGATTGTTACAGTAACACTCACAGTACACGGTAT GTTACAGTTAAGGATCAGTGGCATTCACGCGGAAGCACAG CACTGTATAGAGAGACCTCTAATTTGAATTGTATGGTAACT ATCACTACTGCACGGAGCAAGTACCCTTATCATTTCTTTGCT ACAAGCACGGGCGATGTGGTAGACATCAGCCCCTTCTATAA TGGCACAAATCGGAACGCAAGCTATTTCGGGGAGAACGCC GACAAGTTTTTCATTTTTCCTAATTATACTATTGTTTCTGACT TCGGGAGACCCAACTCCGCCCTGGAAACTCACAGACTGGTT GCGTTCCTCGAAAGAGCAGATTCTGTGATATCCTGGGACAT TCAGGATGAAAAGAACGTCACGTGTCAGCTGACCTTCTGG GAGGCCTCAGAGCGGACGATCCGGTCTGAGGCCGAGGACT CTTACCACTTTAGCAGCGCCAAGTGCACCGCAACCTTCCTGT CTAAAAAACAGGAAGTGAACATGTCCGATTCTGCTTTGGAC TGCGTTCGCGATGAGGCCATCAACAAGCTTCAACAATTTT CAATACCTCCTACAATCAGACATATGAAAAATACGGAAACG TGAGTGTCTTTGAAACCACCGGGGGCCTGGTCGTGTTCTGG CAGGGTATCAAACAGAAGAGCCTGGTGGAACTGGAACGCC TGGCCAACAGAAGCAGTTTGAACCTCACGCACAACCGGAC AAAGAGGAGCACCGACGGAAACAATGCTACACACCTTTCC AACATGGAGTCTGTCCACAATCTGGTTTATGCACAGCTTCA GTTCACTTATGACACACTGCGGGGCTACATAAACAGGGCTC TGGCACAGATAGCCGAGGCTTGCTGTGTGGACCAGCGGAG AACCCTGGAGGTATTTAAAGAACTGTCTAAGATCAACCCCT CTGCCGATTCTGAGCGCTATTTACAACAAACCCATTGCCGCA CGCTTCATGGGGGACGTCCTCGGTCTTGCCTCCTGTGTGAC AATTAACCAGACGAGCGTGAAGGTGCTGCGAGATATGAAC GTGAAGGAATCCCCTGGGCGGTGTTACAGTAGGCCTGTGG TGATTTTCAACTTCGCCAACTCTTCCTGTGTCCAATACGGTC AACTCGGTGAAGATAACGAGATTCTGCTGGGCAATCATCG GACAGAAGAATGCCAGTTGCCAAGCCTTAAAATCTTTATTG CAGGAAATTCAGCCTACGAGTACGTCGACTATCTGTTTAAA AGAATGATTGATCTGAGCAGCATTTCCACTGTGGAC | 266 |
| CMV gB ectodomain, V23 to P707 of SEQ ID NO: 1 (Towne strain) | VSSSSTRGTSATHSHHSSHTTSAAHSRSGSVSQRVTSSQTVSH GVNETIYNTTLKYGDVVGVNTTKYPYRVCSMAQGTDLIRFER NIVCTSMKPINEDLDEGIMVVYKRNIVAHTFKVRVYQKVLTFR RSYAYIHTTYLLGSNTEYVAPPMWEIHHINSHSQCYSSYSRVIA GTVFVAYHRDSYENKTMQLMPDDYSNTHSTRYVTVKDQWH SRGSTWLYRETCNLNCMVTITTARSKYPYHFFATSTGDVVDIS PFYNGTNRNASYFGENADKFFIFPNYTIVSDFGRPNSALETHRL VAFLERADSVISWDIQDEKNVTCQLTFWEASERTIRSEAEDSY HFSSAKMTATFLSKKQEVNMSDSALDCVRDEAINKLQQIFNT SYNQTYEKYGNVSVFETTGGLVVFWQGIKQKSLVELERLANRS SLNLTHNRTKRSTDGNNATHLSNMESVHNLVYAQLQFTYDTL | 267 |

Listing of Raw Sequences

| Construct | Sequence* | SEQ ID NO: |
|---|---|---|
| | RGYINRALAQIAEAWCVDQRRTLEVFKELSKINPSAILSAIYNKP IAARFMGDVLGLASCVTINQTSVKVLRDMNVKESPGRCYSRP VVIFNFANSSYVQYGQLGEDNEILLGNHRTEECQLPSLKIFIAG NSAYEYVDYLFKRMIDLSSISTVDSMIALDIDPLENTDFRVLELY SQKELRSSNVFDLEEIMREFNSYKQRVKYVEDKVVDPLPP | |

*signal sequence M1..A22 (SEQ ID NO: 268) removed

| | | |
|---|---|---|
| Signal Sequence of wt HCMV gB (Towne) | MESRIWCLVVCVNLCIVCLGAA | 268 |
| GCN4 CC tri2 trimerization domain (Table 9) | KIEEILSKQYHIENEIARIKKLIG AAGATCGAGGAGATCCTGTCCAAGCAGTACCACATCGA GAACGAGATCGCCCGCATCAAGAAGCTGATCGGC | 269 270 |
| T4 fibritin foldon domain | GYIPEAPRDGQAYVRKDGEWVLLSTFL | 271 |
| GCN4 (Table 9) | RIKQIEDKIEEILSKQYHIENEIARIKKLIG | 272 |
| GCN4 (Table 9) | KIYHIENEIARIKKLIG | 273 |
| C-terminal fusion sequence (Table 9) | LSAIGGYIPEAPRDGQAYVRKDGEWVLLSTFL | 274 |

Embodiments of the present invention are set out in the following numbered clauses:

C1. A polypeptide comprising at least one introduced amino acid mutation relative to the amino acid sequence of the wild-type HCMV glycoprotein B (gB), wherein the polypeptide comprises a conformation that is not an HCMV gB postfusion conformation.

C2. A polypeptide that binds to an HCMV gB prefusion-specific antibody.

C3. A polypeptide comprising at least one introduced amino acid mutation relative to the amino acid sequence of the wild-type HCMV glycoprotein B (gB), wherein the polypeptide is capable of binding to an HCMV gB prefusion-specific antibody.

C4. A polypeptide comprising at least one introduced amino acid mutation relative to the amino acid sequence of the wild-type HCMV glycoprotein B (gB), wherein the polypeptide is capable of binding to a bis(aryl)thiourea compound.

C5. The polypeptide according to clause C3, wherein the compound is N-{4-[({(1S)-1-[3,5-bis(trifluoromethyl) phenyl]ethyl}carbamothioyl)amino]phenyl}-1,3-thiazole-4-carboxamide.

C6. The polypeptide according to clause C1, wherein said polypeptide is characterized by structure coordinates comprising a root mean square deviation (RMSD) of conserved residue backbone atoms when superimposed on backbone atoms described by structural coordinates of Table 1A.

C7. A polypeptide comprising at least one amino acid mutation relative to the amino acid sequence of the wild-type HCMV gB polypeptide, wherein the amino acid mutation comprises a cysteine substitution.

C8. A polypeptide comprising at least one amino acid mutation relative to the amino acid sequence of the wild-type HCMV gB polypeptide, wherein the amino acid mutation comprises a mutation that allows a disulfide bond to form.

C9. A polypeptide comprising at least one amino acid mutation relative to the amino acid sequence of the wild-type HCMV gB polypeptide, wherein the amino acid mutation comprises an electrostatic mutation.

C10. A polypeptide comprising at least one amino acid mutation relative to the amino acid sequence of the wild-type HCMV gB polypeptide, wherein the amino acid mutation comprises a phenylalanine substitution.

C11. A polypeptide comprising at least one amino acid mutation relative to the amino acid sequence of the wild-type HCMV gB polypeptide, wherein the amino acid mutation comprises a leucine substitution.

C12. A polypeptide comprising at least one amino acid mutation relative to the amino acid sequence of the wild-type HCMV gB polypeptide, wherein the mutation stabilizes prefusion conformation of the polypeptide, and wherein the polypeptide specifically binds to an HCMV gB prefusion-specific antibody.

C13. A polypeptide comprising a cysteine at any one of the amino acid positions listed in column (ii) of Table 2, as compared to SEQ ID NO: 1.

C14. A polypeptide comprising an amino acid substitution at any one of the amino acid positions listed in column (ii) of Table 2, as compared to SEQ ID NO: 1.

C15. A polypeptide comprising the mutations Q98C and I653C according to the numbering of SEQ ID NO: 1.

C16. A polypeptide comprising the mutations T100C and S269C according to the numbering of SEQ ID NO: 1.

C17. A polypeptide comprising the mutations D217C and F584C according to the numbering of SEQ ID NO: 1.

C18. A polypeptide comprising the mutations Y242C and K710C according to the numbering of SEQ ID NO: 1.

C19. A polypeptide comprising the mutations Y242C and D714C according to the numbering of SEQ ID NO: 1.

C20. A polypeptide comprising the mutations S367C and L499C according to the numbering of SEQ ID NO: 1.

C21. A polypeptide comprising the mutations T372C and W506C according to the numbering of SEQ ID NO: 1.
C22. A polypeptide comprising the mutations S550C and D652C according to the numbering of SEQ ID NO: 1.
C23. A polypeptide comprising the mutations T608C and D679C according to the numbering of SEQ ID NO: 1.
C24. A polypeptide comprising the mutations K695C and K724C according to the numbering of SEQ ID NO: 1.
C25. A polypeptide comprising an amino acid sequence that is at least about 90% identical to the amino acid sequence set forth in any one of SEQ ID NOs: 1-43, wherein the polypeptide comprises a mutation as compared to SEQ ID NO: 1.
C26. The polypeptide according to any one of clauses C1-C25, wherein the polypeptide does not comprise a mutation at any one of the following positions: R562, P577, S587, Y588, G592, G595, L601/H605, C610, L612, P613, Y625, Y627, F632, and K633.
C27. The polypeptide according to any one of clauses C1-C26, wherein the polypeptide does not comprise the cytoplasmic tail of HCMV gB.
C28. The polypeptide according to any one of clauses C1-C26, wherein the polypeptide does not comprise the transmembrane region.
C29. The polypeptide according to any one of clauses C1-C26, wherein the polypeptide comprises the cytoplasmic tail of HCMV gB and does not comprise the transmembrane region.
C30. The polypeptide according to any one of clauses C1-C29, wherein the polypeptide does not contain an insect cell pattern of glycosylation.
C31. The polypeptide according to any one of clauses C1-C30, wherein the polypeptide exhibits improved solubility or stability, as compared to a native gB in a postfusion conformation.
C32. The polypeptide according to any one of clauses C1-C31, wherein the polypeptide is immunogenic.
C33. A nucleic acid encoding the polypeptide according to any one of clauses C1-C32.
C34. The nucleic acid according to clause C33, wherein the nucleic acid comprises a self-replicating RNA molecule.
C35. The nucleic acid according to clause C33, wherein the nucleic acid comprises a modified RNA molecule.
C36. A composition comprising a nucleic acid according to any one of clauses C33-C35.
C37. A composition comprising the polypeptide according to any one of clauses C1-C32, and further comprising a CMV antigen.
C38. The composition according to any one of clauses C36-C37, further comprising any one of the following polypeptides: gO, gH, gL, pUL128, pUL130, pUL131, and any combination thereof.
C39. A composition comprising the polypeptide according to any one of clauses C1-C32, and a diluent.
C40. A composition comprising the polypeptide according to any one of clauses C1-C32, and an adjuvant.
C41. The composition according to any one of clauses C36-C40, wherein the composition is immunogenic.
C42. The composition according to any one of clauses C36-C41, for use in eliciting an immune response against cytomegalovirus.
C43. A method of eliciting an immune response in a mammal, the method comprising administering to the mammal an effective amount of the polypeptide according to any one of clauses C1-C32.
C44. A method for reducing cytomegalovirus viral shedding in a mammal, the method comprising administering to the mammal an effective amount of the polypeptide according to any one of clauses C1-C32.
C45. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 1-43.
C46. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 1-106.
C47. A polypeptide comprising at least one amino acid mutation relative to the amino acid sequence of the wild-type HCMV gB, wherein the polypeptide comprises an amino acid sequence having at least 95% identity to the amino acid sequence set forth in any one of SEQ ID NOs: 47-106.
C48. A polypeptide comprising an amino acid sequence having at least 95% identity to the sequence set forth in SEQ ID NO: 57.
C49. A composition comprising at least one polynucleotide encoding an HCMV polypeptide selected from any one of gH, gL, UL128, UL130, and UL131; a polynucleotide encoding HCMV gB or a fragment thereof; a polynucleotide encoding pp65 or a fragment thereof; and a pharmaceutically acceptable carrier or dilent.
C50. A composition comprising at least one polynucleotide comprising a sequence having at least 95% identity to a sequence selected from any one of SEQ ID NOS: 141-210; a polynucleotide encoding a polypeptide comprising an amino acid sequence having at least 95% identity to the amino acid sequence set forth in any one of SEQ ID NOs: 1-106; and a pharmaceutically acceptable carrier or dilent.
C51. A composition comprising at least one polynucleotide comprising a sequence having at least 95% identity to a sequence selected from any one of SEQ ID NOS: 224-254; a polynucleotide encoding a polypeptide comprising an amino acid sequence selected from any one of the amino acid sequences set forth in any one of SEQ ID NOs: 1-106; and a pharmaceutically acceptable carrier or dilent.
C52. A composition comprising at least one polypeptide comprising an amino acid sequence having at least 95% identity to an amino acid sequence selected from any one of SEQ ID NOS: 211-223; a polypeptide comprising an amino acid sequence having at least 95% identity to the amino acid sequence set forth in any one of SEQ ID NOs: 1-106; and a pharmaceutically acceptable carrier or dilent.
C53. A polypeptide comprising at least one amino acid mutation relative to the amino acid sequence of the wild-type HCMV gB, wherein the polypeptide comprises the amino acid sequence set forth in any one of SEQ ID NOs: 1-43, wherein the polypeptide comprises a mutation as compared to SEQ ID NO: 1.
C54. A polypeptide comprising at least one amino acid mutation relative to the amino acid sequence of the wild-type HCMV gB, wherein the polypeptide comprises the amino acid sequence set forth in any one of SEQ ID NOs: 1-106, wherein the polypeptide comprises a mutation as compared to SEQ ID NO: 1.

C55. A polypeptide comprising at least one amino acid mutation relative to the amino acid sequence of the wild-type HCMV gB, wherein the polypeptide comprises the amino acid sequence set forth in any one of SEQ ID NOs: 47-106, wherein the polypeptide comprises a mutation as compared to SEQ ID NO: 1.

C56. A polypeptide comprising the sequence set forth in SEQ ID NO: 57.

C57. A composition comprising at least one polynucleotide encoding an HCMV polypeptide selected from any one of gH, gL, UL128, UL130, and UL131; a polynucleotide encoding HCMV gB or a fragment thereof; a polynucleotide encoding pp65 or a fragment thereof; and a pharmaceutically acceptable carrier or dilent.

C58. A composition comprising at least one polynucleotide comprising a sequence selected from any one of SEQ ID NOS: 141-210; a polynucleotide encoding a polypeptide comprising the amino acid sequence set forth in any one of SEQ ID NOs: 1-106; and a pharmaceutically acceptable carrier or dilent.

C59. A composition comprising at least one polynucleotide comprising a sequence selected from any one of SEQ ID NOS: 224-254; a polynucleotide encoding a polypeptide comprising the amino acid sequence set forth in any one of SEQ ID NOs: 1-106; and a pharmaceutically acceptable carrier or dilent.

C60. A composition comprising at least one polypeptide comprising a sequence selected from any one of SEQ ID NOS: 211-223; a polypeptide comprising the amino acid sequence set forth in any one of SEQ ID NOs: 1-106; and a pharmaceutically acceptable carrier or dilent.

C61. The composition according to any one of clause C49-051 and C57-059, wherein the polynucleotide is DNA.

C62. The composition according to any one of clause C49-051 and C57-059, wherein the polynucleotide is RNA.

C63. The composition according to any one of clause C49-051 and C57-059, wherein at least one polynucleotide comprises at least one chemical modification.

C64. The composition according to clause C61, wherein the chemical modification is selected from the group consisting of pseudouridine, N1-methylpseudouridine, N1-ethylpseudouridine, N1-ethylpseudouridine, 2-thiouridine, 4'-thiouridine, 5-methylcytosine, 2-thio-I-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

C65. The composition according to any one of clause C49-051 and C57-059, wherein the composition is formulated within a cationic lipid nanoparticle.

C66. A composition comprising at least one polynucleotide comprising a sequence selected from any one of SEQ ID NO: 153, SEQ ID NO: 156, SEQ ID NO: 155, SEQ ID NO: 157, SEQ ID NO: 210, SEQ ID NO: 152, and SEQ ID NO: 158; a polynucleotide encoding a polypeptide comprising the amino acid sequence set forth in any one of SEQ ID NOs: 1-106; and a pharmaceutically acceptable carrier or dilent.

C67. A composition comprising at least one polypeptide comprising a sequence selected from any one of SEQ ID NO: 211, SEQ ID NO: 213, SEQ ID NO: 214, SEQ ID NO: 215, SEQ ID NO: 216, and SEQ ID NO: 217; a polypeptide comprising the amino acid sequence set forth in any one of SEQ ID NOs: 1-106; and a pharmaceutically acceptable carrier or dilent.

C68. A polypeptide comprising an amino acid sequence set forth in any one of SEQ ID NOs: 1-106.

C69. The polypeptide according to clause C68, wherein the sequence comprises SEQ ID NO: 56.

C70. The polypeptide according to clause C68, wherein the sequence comprises SEQ ID NO: 57.

C71. The polypeptide according to clause C68, wherein the sequence comprises SEQ ID NO: 58.

C72. The polypeptide according to clause C68, wherein the sequence comprises SEQ ID NO: 75.

C73. A polynucleotide encoding a polypeptide comprising an amino acid sequence set forth in any one of SEQ ID NOs: 1-106.

C74. A composition comprising a polypeptide comprising the sequence set forth in any one of SEQ ID NOs:1-106; and a diluent.

C75. The composition according to clause C74, wherein the sequence does not comprise any one of SEQ ID NO: 59, SEQ ID NO: 75, SEQ ID NO: 76, SEQ ID NO: 71, SEQ ID NO: 52, SEQ ID NO: 96, and SEQ ID NO: 50.

C76. The composition according to clause C74, further comprising a polypeptide comprising any one sequence selected from SEQ ID NOS: 211-224.

C77. A composition comprising a polynucleotide encoding a polypeptide comprising the sequence selected from any one of SEQ ID NOs:1-106; and a diluent.

C78. The composition according to clause C77, further comprising a polynucleotide comprising a sequence selected from any one of SEQ ID NOS: 141-210.

C79. The composition according to clause C77, further comprising a polynucleotide comprising a sequence selected from any one of SEQ ID NOS: 224-254.

C80. A method of eliciting an immune response in a mammal, comprising administering an effective amount of a composition comprising a polypeptide comprising the sequence set forth in any one of SEQ ID NOs:1-106; and a diluent.

C81. A method of eliciting an immune response in a mammal, comprising administering an effective amount of a composition comprising a polynucleotide encoding a polypeptide comprising the sequence set forth in any one of SEQ ID NOs:1-106; and a diluent.

SEQUENCE LISTING (274 sequences)

SEQ ID NO: 1 - protein, 907 aa, Artificial Sequence
  Synthetic amino acid sequence: Original HCMV gB (Towne) sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 2 - protein, 907 aa, Artificial Sequence
  Synthetic amino acid sequence: gB-001 Q98C, G271C sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTCDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 3 - protein, 907 aa, Artificial Sequence
  Synthetic amino acid sequence: gB-002  Q98C, I653C sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 4 - protein, 907 aa, Artificial Sequence
  Synthetic amino acid sequence: gB-003 G99C, A267C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQCTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFCTSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 5 - protein, 907 aa, Artificial Sequence
  Synthetic amino acid sequence: gB-004 T100C, A267C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFCTSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 6 - protein, 907 aa, Artificial Sequence
  Synthetic amino acid sequence: gB-005 T100C, S269C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 7 - protein, 907 aa, Artificial Sequence
  Synthetic amino acid sequence: gB-006 T100C, L651C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIACDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 8 - protein, 907 aa, Artificial Sequence
  Synthetic amino acid sequence: gB-007 D217C, F584C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNCANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 9 - protein, 907 aa, Artificial Sequence
  Synthetic amino acid sequence: gB-008 Y218C, A585C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDCSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFCNSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 10 - protein, 907 aa, Artificial Sequence
  Synthetic amino acid sequence: gB-009 S219C, D654C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDICPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 11 - protein, 907 aa, Artificial Sequence
  Synthetic amino acid sequence: gB-010 N220C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSCTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 12 - protein, 907 aa, Artificial Sequence
  Synthetic amino acid sequence: gB-011 T221C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNCHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 13 - protein, 907 aa, Artificial Sequence
  Synthetic amino acid sequence: gB-012 W240C, G718C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSCLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 14 - protein, 907 aa, Artificial Sequence
  Synthetic amino acid sequence: gB-013 Y242C, K710C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLCGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 15 - protein, 907 aa, Artificial Sequence
  Synthetic amino acid sequence: gB-014 Y242C, D714C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDCLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 16 - protein, 907 aa, Artificial Sequence
  Synthetic amino acid sequence: gB-015 S269C, I653C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 17 - protein, 907 aa, Artificial Sequence
  Synthetic amino acid sequence: gB-016 G271C, P614C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTCDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLCSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 18 - protein, 907 aa, Artificial Sequence
  Synthetic amino acid sequence: gB-017 S367C, L499C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRACAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 19 - protein, 907 aa, Artificial Sequence
  Synthetic amino acid sequence: gB-018 T372C, W506C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMCATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEACCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 20 - protein, 907 aa, Artificial Sequence
  Synthetic amino acid sequence: gB-019 F541C, Q669C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARCMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSCKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 21 - protein, 907 aa, Artificial Sequence
  Synthetic amino acid sequence: gB-020 L548C, A650C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGCASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMICLDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 22 - protein, 907 aa, Artificial Sequence
  Synthetic amino acid sequence: gB-021 A549C, I653C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLCSCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDCDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 23 - protein, 907 aa, Artificial Sequence
  Synthetic amino acid sequence: gB-022 S550C, D652C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALCIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 24 - protein, 907 aa, Artificial Sequence
  Synthetic amino acid sequence: gB-023 G604C, F661C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLCNHRTEECQLPSLKIFIAGNSAYEYVDYLFKRMIDLSSISTVDSMIALDIDPLENTDCRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 25 - protein, 907 aa, Artificial Sequence
  Synthetic amino acid sequence: gB-024 N605C, E665C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGCHRTEECQLPSLKIFIAGNSAYEYVDYLFKRMIDLSSISTVDSMIALDIDPLENTDFRVLCLYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 26 - protein, 907 aa, Artificial Sequence
  Synthetic amino acid sequence: gB-025 R607C, S675C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHCTEECQLPSLKIFIAGNSAYEYVDYLFKRMIDLSSISTVDSMIALDIDPLENTDFRVLELYSQKELRSCNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 27 - protein, 907 aa, Artificial Sequence
  Synthetic amino acid sequence: gB-026 T608C, D679C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRCEECQLPSLKIFIAGNSAYEYVDYLFKRMIDLSSISTVDSMIALDIDPLENTDFRVLELYSQKELRSSNVFCLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 28 - protein, 907 aa, Artificial Sequence
  Synthetic amino acid sequence: gB-027 E609C, F678C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTCECQLPSLKIFIAGNSAYEYVDYLFKRMIDLSSISTVDSMIALDIDPLENTDFRVLELYSQKELRSSNVCDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 29 - protein, 907 aa, Artificial Sequence
  Synthetic amino acid sequence: gB-028 R673C, S674C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELCCSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 30 - protein, 907 aa, Artificial Sequence
  Synthetic amino acid sequence: gB-029 N676C, V677C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSCCFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 31 - protein, 907 aa, Artificial Sequence
  Synthetic amino acid sequence: gB-030 L680C, E681C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCCEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 32 - protein, 907 aa, Artificial Sequence
  Synthetic amino acid sequence: gB-031 I683C, M684C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECCREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 33 - protein, 907 aa, Artificial Sequence
  Synthetic amino acid sequence: gB-032 F687C, N688C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRECCSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 34 - protein, 907 aa, Artificial Sequence
  Synthetic amino acid sequence: gB-033 Y690C, K691C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSCCQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 35 - protein, 907 aa, Artificial Sequence
  Synthetic amino acid sequence: gB-034 K695C, K724C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVCYVEDKVVDPLPPYLKGLDDLMSGLGAAGCAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 36 - protein, 907 aa, Artificial Sequence
  Synthetic amino acid sequence: gB-035 T746C, F747C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVACCLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 37 - protein, 907 aa, Artificial Sequence
  Synthetic amino acid sequence: gB-036 K749C, N750C
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLCCPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 38 - protein, 907 aa, Artificial Sequence
  Synthetic amino acid sequence: gB-037 K670L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQLELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 39 - protein, 907 aa, Artificial Sequence
  Synthetic amino acid sequence: gB-038 K670F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQFELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 40 - protein, 907 aa, Artificial Sequence
  Synthetic amino acid sequence: gB-039 R673L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELLSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 41 - protein, 907 aa, Artificial Sequence
  Synthetic amino acid sequence: gB-040 R673F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELFSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 42 - protein, 907 aa, Artificial Sequence
  Synthetic amino acid sequence: gB-041 K691L
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYLQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 43 - protein, 907 aa, Artificial Sequence
  Synthetic amino acid sequence: gB-042 K691F
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYFQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 44 - protein, 630 aa, Human cytomegalovirus
YGDVVGVNTTKYPYRVCSMAQGTDLIRFERNIICTSMKPINEDLDEGIMVVYKRNIVAHTFKVRVYQKVLTFRRSYAGHRTTYLLGSNTEYVAPPMWEIHHINKFAQCYSSYSRVIGGTVFVAYHRDSHENKTMQLIPDDYSNTHSTRYVTVKDQWHSRGSTATHRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHDDDDKSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPP

SEQ ID NO: 45 - protein, 705 aa, Artificial Sequence
  Synthetic sequence: gB705
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAGHRTTYLLGSNTEYVAPPMWEIHHINRHSQCYSSYSRVIAGTVFVAYHRDSYENKTMQLMLDDYSNTHSTRYVTVKDQWHSRGSTALYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRATKASTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPP

SEQ ID NO: 46 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 47 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSCAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTCFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 48 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMACGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 49 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTACSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 50 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 51 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGCDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 52 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPCNEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNCSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 53 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPCNEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTCYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 54 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSCAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGCDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 55 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLCGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLCSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 56 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANCSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 57 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 58 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNCANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 59 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFCNSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 60 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYCNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFACSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 61 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSCTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENCDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 62 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHCTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENCDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 63 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGCVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 64 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTCLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGCAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 65 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGCAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 66 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLCRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAICAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 67 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTACSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 68 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPCENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 69 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATCTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 70 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGCVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLCSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 71 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDCVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYCDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 72 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFCEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMICLDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 73 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALCQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 74 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFCSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQICEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 75 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSACMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALACIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 76 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSCINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 77 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKCNPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEECMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 78 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKCNPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 79 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKICPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 80 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINCSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLCEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 81 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAACFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 82 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARCMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDCEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 83 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGCASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDCLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 84 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLCSCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLECTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 85 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDCLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 86 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLACCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLCNTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 87 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVCYGQLGEDNEILLGNHRTEECQLPSLKIFIAGNSAYEYVDYLFKRMIDLSSISTVDSMIALDIDPLENTDFRVLELYCQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 88 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILCGNHRTEECQLPSLKIFIAGNSAYEYVDYLFKRMIDLSSISTVDSMIALDIDPLENTDFRVLELCSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 89 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLCNHRTEECQLPSLKIFIAGNSAYEYVDYLFKRMIDLSSISTVDSMIALDIDPLENTDFRVLELYSQKECRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 90 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHCTEECQLPSLKIFIAGNSAYEYVDYLFKRMIDLSSISTVDSMIALDIDPLENTDFRVLELYSQKELRSSNVFDLEEIMREFCSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 91 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRCEECQLPSLKIFIAGNSAYEYVDYLFKRMIDLSSISTVDSMIALDIDPLENTDFRVLELYSQKELRSSNVFDLEEIMREFNSYKCRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 92 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTCECQLPSLKIFIAGNSAYEYVDYLFKRMIDLSSISTVDSMIALDIDPLENTDFRVLELYSQKELRSSNVFDLEEIMREFNSYCQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 93 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTECCQLPSLKIFIAGNSAYEYVDYLFKRMIDLSSISTVDSMIALDIDPLENTDFRVLELYSQKELRCSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 94 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTECCQLPSLKIFIAGNSAYEYVDYLFKRMIDLSSISTVDSMIALDIDPLENTDFRVLELYSQKELRSCNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 95 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECCLPSLKIFIAGNSAYEYVDYLFKRMIDLSSISTVDSMIALDIDPLENTDFRCLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 96 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGACASVVEGVATFLKNPFGACTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 97 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVCEGVATFLKNPFGCFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 98 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVCEGVATFLKNPFGACTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 99 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFSLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 100 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFNLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 101 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLESIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 102 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEQIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 103 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRSFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 104 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMRQFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 105 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPIPEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 106 - protein, 907 aa, Artificial Sequence
  Synthetic amino acid sequence
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVPSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 107 - protein, 630 aa, Artificial Sequence; identical to SEQ ID NO: 44
  >5CXF:A|PDBID|CHAIN|SEQUENCE

SEQ ID NO: 108 - protein, 630 aa, Artificial Sequence; identical to SEQ ID NO: 44
  >5CXF:B|PDBID|CHAIN|SEQUENCE

SEQ ID NO: 109 - protein, 630 aa, Artificial Sequence; identical to SEQ ID NO: 44
  >5CXF:C|PDBID|CHAIN|SEQUENCE

SEQ ID NO: 110 - protein, 905 aa, Human cytomegalovirus
MESRIWCLVVCVNLCIVCLGAAVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 111 - protein, 905 aa, Human cytomegalovirus
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 112 - protein, 905 aa, Human cytomegalovirus
MESRIWCLVVCVNLCIVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 113 - protein, 905 aa, Human cytomegalovirus
MESRIWCLVVCVNLCYVCLGAVVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 114 - protein, 905 aa, Human cytomegalovirus
MESRIWCLVVCVNLCIVCLGVAVSSSSTSHATSSAHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 115 - protein, 905 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINRNSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRDQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFRELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 116 - protein, 905 aa, Human cytomegalovirus
MESRIWCLVVCVNLCIVCLGAAVSSSSTSHATSSTHNGSHASRTTSAQTRSVSSQHVTSSKAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMLDDYSNTHSIRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRNQALDKLQQIFNASYNQTYEKYGNVSVFETTGGLVVFWQGIKQKSLLELERLANSSGVNSTRRTKRSTGNTTTLSPESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 117 - protein, 904 aa, Human cytomegalovirus
MESRIWCLVVCVNLCIVCLGAAVSSSSTRGTSATHNGSHTSHTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMLDDYSNTHSTRYVTVKDQWHSRGSTWLYRETCNLNCMVTITTARSKYPYHFFATSTGDVVDISPFYNGTNRNTSYFGENADKFFIFPNYTIVSDFGRANSAPETHRLVAFLERADSVISWDIQDEKNVTCQLTFWEASERTIRSEAEDSYHFSSAKMTATFLSKKQEVNMSDPVLDCVRNQALNKLQQIFNASYNQTYEKYGNVSVFETTGGLVVFWQGIKQKSLLELERLANSSGVNSTRRTKRSTGNTTTLSLESESVRNVLYAQLQFTYDTLRSYINRALAQIAEAWCVDQRRTLEVFKELSKINPSAILSAIYNKPIAARFMGDVLGLASCVTINQTSVKVLRDMNVKESPGRCYSRPVVIFNFVNSSYVQYGQLGEDNEILLGNHRTEECQFPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSSSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 118 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVYISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 119 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 120 - protein, 906 aa, Human cytomegalovirus
MESRIWCLVVCVNLCIVCLGAAVSSSSTSHATSSTHNGSHTSRTTSAQTRSVYSQHVTSSEAVSHRANETIYNTTLKYGDVVGVNTTKYPYRVCSMAQGTDLIRFERNIICTSMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQAGTQDKGQKPNLLDRLRHRKNGYRHLKDSDEEENV

SEQ ID NO: 121 - protein, 906 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINKFAQCYSSYSRVIGGTVFVAYHRDSYENKTMQLMSDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 122 - protein, 906 aa, Human cytomegalovirus
MESRIWCLVVCVNLCIVCLGAAVSSSSTSHATSSTHNGSHTSRTTSAQTRSVSSQHVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIHTTYLLGSNTEYVAPPMWEIHHINKFAQCYSSYSRVIGGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 123 - protein, 907 aa, Human cytomegalovirus
MESRIWCLVVCVNLCIVCLGAAVSSSSTHGTSATHSHHSSHTTSAAHSRSGSVSSQRVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 124 - protein, 907 aa, Human cytomegalovirus
MESRIWCLVVCVNLCIVCLGAAVSSSSTHGTSATHSHHSSHTTSAAHSRSGSVSSQRVTSSEAVSHRANETIYNTTLKYGDVVGVNTTKYPYRVCSMAQGTDLIRFERNIVCTPMKPINEDLDEGIMVVYKRNIVAHTFKVRVYQKVLTFRRSYAYIYTTYLLGSNTEYVAPPMWEIHHINKFAQCYSSYSRVIGGTVFVAYHRDSYENKTMQLIPDDYSNTHSTRYVTVKDQWHSRGSTWLYRETCNLNCMLTITTARSKYPYHFFATSTGDVVDISPFYNGTNRNASYFGENADKFFIFPNYTIVSDFGRPNAAPETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETSGGLVVFWQGIKQKSLVELERLANRSSLNITHRTRRSTSDNNTTHLSSMESVHNLVYAQLQFTYDTLRGYINRALAQIAEAWCVDQRRTLEVFKKLSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 125 - protein, 906 aa, Human cytomegalovirus
MESRIWCLVVCVNLCIVCLGAAVSSSTSHATSSTHNGSHTSRTTSAQTRSVSSQHVTSSEAVSHRANETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRSVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTNGNNATHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 126 - protein, 906 aa, Human cytomegalovirus
MESRIWCLVVCVNLCIVCLGAAVSSSTSHATSSTHNGSHTSRTTSAQTRSVSSQHVTSSEAVSHRANETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRSVAFLERAESVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTNGSNATHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 127 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 128 - protein, 907 aa, Human cytomegalovirus
MESRIWCLVVCVNLCIVRLGAAVSSSSTRGTSATHSHHSSRTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGNVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 129 - protein, 907 aa, Human cytomegalovirus; identical to SEQ ID NO: 46

SEQ ID NO: 130 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTLGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 131 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSVLDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 132 - protein, 908 aa, Human cytomegalovirus
MESRIWCLVVCVNLCIVCLGAAVSSSSTSRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHSRTKRSADGNNATHLSSMESVHNLVYAQLQFTYDTLRGYINRALAQIAEAWCVDQRRSLEVFKELSKINPSAILSAIYNKPIAARFMGDVLGLASCVTINQTSVKVLRDMNVKDSPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCMQPLQNLFPYLVSANGTTVTSGNTKDTSLQAPPSYEESVYNSGRKGSGPPSSDASTAAPPYTNEQAYQMLLALVRLDAEQRAQQNGTDSLDGQTGTQDKGQKPNLLDRLRHRKNGYRHLKDSDEEENV

SEQ ID NO: 133 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEAPERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGRTGTQDKGQKPNLLDRLRHRKNGYRHLKDSDEEENV

SEQ ID NO: 134 - protein, 907 aa, Human cytomegalovirus
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRANSAPETHRLVAFLERADSVISWDIQDEKNVTCQLTFWEASERTIRSEAEDSYHFSSAKMTATFLSKKQEVNMSDSVLDCVRDEAINKLQQIFNTSYNQTYEKYGNVSVFETTGGLVVFWQGIKQKSLVELERLANRSSLNLTHSRAKRSADGNNTTHLSNMESVHNLVYAQLQFTYDTLRGYINRALAQIAEAWCVDQRRSLEVFRELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 135 - protein, 905 aa, Human cytomegalovirus
MESRIWCLVVCVNLCIVCLGAAVSSSTSRATSTHNGSHISRTTSAQTRSISSQRVTSSEAVSHRANETIYNTTLKYGDVVGVNTTKYPYRVCSMAQGTDLIRFDRNIVCTPMKPINEDLDEGIMVVYKRNIVAHTFKVRVYQKVLTFRRSYAYIHTTYLLGSNTEYVAPPMWEIHHINRHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEESYHFSSAKMTATFLSKKQEVNMSDSALDCVRDEALNKLQQIFNTSYNQTYEKYGNVSVFETTGGLVVFWQGIKQKSLVELERLANRSSLNLTHSRTRRSTDGTNVTHLSNMDSVHNLVYAQLQFTYDTLRGYINRALTQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 136 - protein, 905 aa, Human cytomegalovirus
MESRIWCLVVCVNLCIVCLGAAVSSSTSRATSTHNGNHTSHTTSAQTRSISSQRVTSSEAVSHRANETIYNTTLKYGDVVGVNTTKYPYRVCSMAQGTDLIRFDRNIVCTPMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEESYHFSSAKMTATFLSKKQEVNMSDSALDCVRDEALNKLQQIFNASYNQTYEKYGNVSVFETTGGLVVFWQGIKQKSLVELERLANRSSLNLTHSRTRRSTDGTNVTHLSNMDSVHNLVYAQLQFTYDTLRGYINRALTQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 137 - protein, 907 aa, Human cytomegalovirus; identical to SEQ ID NO: 1

SEQ ID NO: 138 - protein, 907 aa, Human cytomegalovirus
MESRIWCLVVCVNLCIVCLGAAVSSSSTRGTSSTHSHHSSHTTSAAHSRSGSVSQRVTSSQTVSHGVNETIYNTTLRYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSIDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 139 - protein, 907 aa, Human cytomegalovirus
MESRIWCLVVCVNLCIVCLGAAVSSSSTTGSRGTSTHNHHSSHTTSAARSQSGSVSHHVTSSQTVSHDVNETIYNTTLKYGDVVGVNTTKYPYRVCSMAQGTDLIRFERNIVCTPVKPINEDLDEGIMVVYKRNIVAHTFKVRVYQKVLTFRRSYAYIYSTYLLGSNTEYVAPPMWEIHHINKFAQCYSSYSRVIAGTLFVAYHRDSYENKTMQLMSDDYSNTHSTRYVTVKDQWHSRGSTWLYHETCNLNCMVTMTAARSKYPYHFFATSTGDVVDISPFYNGTNRNTSYFGENADKFFIFPNYTIVSDFGRPNAAQETHRLVAFLERADSVISWDIQDEKNVTCQLTFWEASERTIRSEAKDSYHFSSAKMTATFLSKKQEVNMSDPVLDCVRDQALNKLQQIFNASYNQTYEKYGNVSVFETTGGLVVFWQGIKQKSLLELERLANSSGVNATRRSKRSTNNTTTLSLENDSVRSVLYAQLQFTYDTLRNYINRALAQIAEAWCVDQRRTLEVFKELSKINPSAILSAIYNKPIAARFMGDVLGLASCVTINQTSVKVLRDMTIKDSTGRCYSRPVVIFTFANSSHVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAPPYTNEQAYQMLLALARLDAEQRAQQNGTDSLDGQTGTQDKGQKPNLLDRLRHRKNGYRHLKDSDEEENV

SEQ ID NO: 140 - protein, 907 aa, Human cytomegalovirus
MESRIWCLVVCVNLCIVCLGAAVSSSSTTGSRGTSTHNHHSSHTTSAARSQSGSVSHHVTSSQTVSHDVNETIYNTTLKYGDVVGVNTTKYPYRVCSMAQGTDLIRFERNIVCTPVKPINEDLDEGIMVVYKRNIVAHTFKVRVYQKVLTFRRSYAYIYSTYLLGSNTEYVAPPMWEIHHINKFAQCYSSYSRVIAGTLFVAYHRDSYENKTMQLMSDDYSNTHSTRYVTVKDQWHSRGSTWLYHETCNLNCMVTMTAARSKYPYHFFATSTGDVVDISPFYNGTNRNTSYFGENADKFFIFPNYTIVSDFGRPNAAQETHRLVAFLERADSVISWDIQDEKNVTCQLTFWEASERTIRSEAKDSYHFSSAKMTATFLSKKQEVNMSDPVLDCVRDQALNKLQQIFNASYNQTYEKYGNVSVFETTGGLVVFWQGIKQKSLLELERLANSSGVNATRRSKRSTNNTTTLSLENDSVRSVLYAQLQFTYDTLRNYINRALAQIAEAWCVDQRRTLEVFKELSKINPSAILSAIYNKPIAARFMGDVLGLASCVTINQTSVKVLRDMTIKDSTGRCYSRPVVIFTFANSSHVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIITYLIYTRQRRLCTQPLQNLFPYLVSADGTTVTSGSTKDTSLQAPPSYEESVYNSGRKGPGPPSSDASTAAQPYTNEQAYQMLLALARLDAEQRAQQNGTDSLNGQTGTQDKGQKPNLLDRLRHRKNGYRHLKDSDEEENV

SEQ ID NO: 141 - DNA, 2437 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaacttcttccaaagctataatcaatactatgtattccatatgcctcgatgtctctttgcgggtcctctggcggagcagtttctgaaccaggtagatctgaccgaaaccctggaaagataccaacagagacttaacacttacgcgctggtatccaaagacctggccagctaccgatctttctcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgagaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaagaacggtacggtactagaagtaactgacgtcgtcgtggacgccaccgacagtcgtctcctcatgatgtccgtctacgcgctatcggccatcatcggcatctatctgctctaccgcatgctcaagacatgctgataataggctggagcctcggtggccatgcttcttgccccttgggcctccccccagcccctcctccccttcctgcacccgtacccccgtggtctttgaataaagtctgagtgggcggc

SEQ ID NO: 142 - DNA, 1045 bp, Artificial Sequence
  Synthetic polypeptide
tcaagcttttggaccctcgtacagaagctaatacgactcactatagggaaataagagagaaaagaagagtaagaagaaatataagagccaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 143 - DNA, 724 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagtgataataggctggagcctcggtggccatgcttcttgccccttgggcctccccccagcccctcctccccttcctgcacccgtacccccgtggtctttgaataaagtctgagtgggcggc

SEQ ID NO: 144 - DNA, 846 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcgctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 145 - DNA, 598 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaagaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 146 - DNA, 2933 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtcttgataataggctggagcctcggtggccatgcttcttgccccttgggcctccccccagcccctcctccccttcctgcacccgtacccccgtggtctttgaataaagtctgagtgggcggc

SEQ ID NO: 147 - DNA, 1882 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgagactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggagccatggcgagcgcctccacttccgcgggctcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggttgataataggctggagcctcggtggccatgcttcttgccccttgggcctccccccagcccctcctccccttcctgcacccgtacccccgtggtctttgaataaagtctgagtgggcggc

SEQ ID NO: 148 - DNA, 3364 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaaaatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacgggggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggggccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccagtgataataggctggagcctcggtggccatgcttcttgccccttgggcctccccccagcccctcctccccttcctgcacccgtacccccgtggtctttgaataaagtctgagtgggcggc

SEQ ID NO: 149 - DNA, 3352 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcgggtcatgtgctgaaagcggtgtttagtcgcggcgatacgccagtactgccgcacgagacgcgactcctgcagacaggtatccacgtacgcgtgagccagccctcgctcatcctggtgtcgcagtacacgcccgactcgacgccatgccaccgcggcgacaatcagctgcaggtgcagcacacgtactttacgggcagcgaggtggagaacgtgtcggtcaacgtccacaaccccacgggtcgaagcatctgcccctctcaagagcccatgtcgatctatgtgtacgcgctgccgctcaagatgctgaacatcccgagcatcaacgtgcaccactacccgagcgcggccgagcgcaaacaccgacacctgcccgtagccgacgctgttattcacgcgtcgggcaagcagatgtggcaagcgcgcctcacggtctcgggactagcctggacgcgtcagcagaaccagtggaaagagcccgacgtctactacacgtcagcgttcgtgtttcccaccaaggacgtggcactgcgccacgtggtgtgtgcgcacgagctggtttgctccatggagaatacgcgcgcaaccaagatgcaggtgataggtgatcaatacgtcaaggtgtacctggagtccttctgcgaggatgtgccctccggtaagctctttatgcacgtcacgctgggctctgacgtggaagaggacctaacgatgacccgcaatccgcaacccttcatgcgcccccacgagcgcaacggctttacggtgttgtgtcctaaaaatatgataatcaaaccaggcaagatctcgcacatcatgctggatgtggcttttacctcacacgagcattttgggctgctgtgtcccaagagcatcccgggcctgagcatctcaggtaacctgttgatgaacgggcagcaaatctttctcgaggtgcaagctatacgcgagaccgtcgaactgcgtcagtacgatcccgtggctgcgctgttctttttcgatatcgacttgttgctgcagcgcgggcctcagtacagcgagcaccccaccttcaccagccagtatcgcatccagggcaagcttgagtaccgacacacctgggaccggcacgacgagggagccgcccagggcgacgacgacgtctggacctctggatcggactccgacgaagaactcgtaacgaccgagcgtaagaccccccgcgtcaccggcggcggcgccatggcgtccgcctcaacttccgcgggctcagcatcctcggctacggcgtgcacggcgggcgttatgacacgtggcagacttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgctcgcaggccatggcggcattgcagaacttgcctcagtgctctcctgatgagattatgtcttatgcccagaaaatctttaagattttggatgaggagcgagacaaggtgcttacgcacattgatcacatatttatggatatcctcactacatgtgttgaaacgatgtgcaatgagtacaaggtcactagtgacgcttgtatgatgaccatgtacgggggcatatctctcttaagtgaattctgtcgggtgctgtgctgctacgtcttagaggagactagtgtgatgctggccaagcggcctctgataaccaagcctgaggtcatcagtgtaatgaagcgccgcattgaggagatctgcatgaaggtctttgcccagtacattctgggggccgatcctttgagagtctgctctccaagtgtggatgacctacgggccatcgccgaggagtcagacgaggaagaggctattgtagcctacactttggccaccgctggtgccagctcctctgactctctggtgtcacctccagaatcccctgtgcccgcgacaatccctctgtcctcagtaattgtggctgagaacagtgatcaggaagaaagtgaacagagtgatgaggaacaggaggagggtgctcaggaggagcgggaggatactgtgtctgtcaagtctgagccagtgtctgaaattgaggaagttgcctcagaggaagaggaggatggtgctgaggaacccaccgcctctggaggcaagtccacccaccctatggtaactagatcaaaggctgaccagtgataataggctggagcctcggtggccatgcttcttgccccttgggcctccccccagcccctcctccccttcctgcacccgtacccccgtggtctttgaataaagtctgagtgggcggc

SEQ ID NO: 150 - DNA, 1473 bp, Artificial Sequence
  Synthetic polypeptide
atggagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaagacctttgaacaagtgaccgaggattgcaacgagaaccccgagaaagatgtcctgacagaactcgtcaaacagattaaggttcgagtggacatggtgcggcatagaatcaaggagcacatgctgaagaaatatacccagacggaagagaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttgggcggtgcactgcaggctaaggcccgtgctaagaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaagatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacggcggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggagccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccag

SEQ ID NO: 151 - DNA, 1740 bp, Artificial Sequence
  Synthetic polypeptide
atggagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaagacctttgaacaagtgaccgaggattgcaacgagaaccccgagaaagatgtcctgacagaactcggtgacatcctcgcccaggctgtcaatcatgccggtatcgattccagtagcaccggccccacgctgacaacccactcttgcagcgttagcagcgcccctcttaacaagccgacgcccaccagcgtcgcggttactaacactcctctccccggggcatccgctactcccgagctcagcccgcgtaagaaaccgcgcaagaccacgcgtcctttcaaggtgattattaaaccgcccgtgcctcccgcgcctatcatgctgcccctcatcaaacaggaagacatcaagcccgagcccgactttaccatccagtaccgcaacaagattatcgataccgccggctgtatcgtgatctctgatagcgaggaagaacagggtgaagaagtcgagacccgcggtgctaccgcgtcttccccttccaccggcagcggcacgccgcgagtgacctctcccacgcacccgctctcccagatgaaccaccctcctcttcccgatcctttgggccggcccgatgaagatagttcctcttcgtcttcctcctcctgcagttcggcttcggacagcgagagtgagtccgaggagatgaaatgcagcagtggcggaggagcatccgtgacctcgagccaccatgggcgcggcggttttggtggcgcggcctcctcctctctgctgagctgcggacatcagagcagcggcggggcgagcaccggacctcgcaagaagaagagcaaacgcatctccgagttggacaacgagaaggtgcgcaatatcatgaaagataagaacacgcccttctgcacacccaacgtgcagactcggcggggtcgcgtcaagattgacgaggtgagccgcatgttccgtcacaccaatcgttctcttgagtacaagaatctgccattcatgatccctagtatgcaccaagtgttagaagaggccatcaaagtttgcaagaccatgcaggtgaacaacaagggcattcagatcatctacacccgcaatcatgaagtgaagaatgaggtggatcaggtacggtgtcgcctgggtagcatgtgcaacctggccctctccactcccttcctcatggagcacactatgcctgtgacacaccctcctgatgtggcgcagcgcacggccgatgcttgtaacgacggtgtcaaggccgtgtggaacctcaaagaactgcacacccaccaattgtgcccgcgctcttctgattaccgcaacatgattatccacgctgccacgcccgtggacctgttgggcgctctcaacctgtgcctgcccctgatgcagaagtttcccaaacaggtcatggtgcgcatcttctccaccaaccagggtgggttcatgctgcctatctacgagacggccgcgaaggcctacgccgtggggcagtttgagaagcccaccgagacccctcccgaagacctggacaccctgagcctggccatcgaggcagccatccaggacctgaggaacaaatctcag

SEQ ID NO: 152 - DNA, 2721 bp, Artificial Sequence
  Synthetic polypeptide
atggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtc

SEQ ID NO: 153 - DNA, 2226 bp, Artificial Sequence
  Synthetic polypeptide
atgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaacttcttccaaagctataatcaatactatgtattccatatgcctcgatgtctctttgcgggtcctctggcggagcagtttctgaaccaggtagatctgaccgaaaccctggaaagataccaacagagacttaacacttacgcgctggtatccaaagacctggccagctaccgatctttctcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgagaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaagaacggtacggtactagaagtaactgacgtcgtcgtggacgccaccgacagtcgtctcctcatgatgtccgtctacgcgctatcggccatcatcggcatctatctgctctaccgcatgctcaagacatgc

SEQ ID NO: 154 - DNA, 2226 bp, Artificial Sequence; identical to SEQ ID NO: 153
  Synthetic polypeptide

SEQ ID NO: 155 - DNA, 513 bp, Artificial Sequence
  Synthetic polypeptide
atgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcag

SEQ ID NO: 156 - DNA, 834 bp, Artificial Sequence
  Synthetic polypeptide
atgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgc

SEQ ID NO: 157 - DNA, 642 bp, Artificial Sequence
  Synthetic polypeptide
atgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtt

SEQ ID NO: 158 - DNA, 1671 bp, Artificial Sequence
  Synthetic polypeptide
atggagtcgcgcggtcgccgttgtcccgaaatgatatccgtactgggtcccatttcggggcacgtgctgaaagccgtgtttagtcgcggcgatacgccggtgctgccgcacgagacgagactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggagccatggcgagcgcctccacttccgcgggctcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggt

SEQ ID NO: 159 - DNA, 1683 bp, Artificial Sequence
  Synthetic polypeptide
atggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaagaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaagaagcaccgaggt

SEQ ID NO: 160 - DNA, 2721 bp, Artificial Sequence
  Synthetic polypeptide
atggaaagccggatctggtgtcttgtggtgtgcgtgaatctttgcatcgtgtgcttgggtgccgccgtgtcatctagcagcacaagaggcacctccgccactcactcacaccacagcagccacacgaccagcgccgctcactccagaagcggctctgtaagccagagagtgaccagttctcaaaccgtcagccacggcgtcaatgagacgatatataatacaaccctgaagtatggagacgtggtgggtgtcaataccaccaagtacccttatcgcgtgtgcagcatggcccagggcactgacctgatcagattcgagagaaatatcgtctgcacctccatgaagcctatcaacgaggaccttgacgagggcatcatggttgtctacaagagaaacattgtggctcacaccttcaaggtgagagtgtatcagaaagtactgacctttaggagatcctacgcttacatccacaccacgtacctgctcggctccaacaccgagtatgtggctccacccatgtgggagattcatcacatcaattcccacagccaatgttacagttcctatagcagagtcattgctggtaccgtgttcgtcgcttaccacagagacagctatgagaacaagaccatgcagttgatgcccgatgactactccaatacacactctacaaggtatgtgacagtcaaagatcagtggcacagccggggcagcacctggctgtaccgagagacatgtaatctgaattgtatggtgactatcactacagccaggagcaaatatccataccacttcttcgccactagcaccggggacgtcgtggacatttccccattctacaatggcacaaacagaaacgccagctacttcggcgagaatgccgacaagttctttatattccccaactataccatcgtgagcgacttcggccgccccaacagcgccctggaaacccaccggctcgtggcctttctcgagcgggccgatagcgtcatatcctgggacatccaggacgagaagaatgtgacatgccagctgaccttctgggaggcctccgagcgtaccatccggtccgaggcagaggacagctaccatttcagcagcgccaagatgaccgcaaccttcctcagtaagaaacaggaggttaacatgtctgattctgccctggactgcgtgcgcgatgaggcaatcaacaagctgcagcagatcttcaacacatcttacaaccaaacttacgagaagtacggcaacgtcagcgtgttcgagacaacaggaggcctggtagtgttctggcaaggtatcaagcagaagagtctggtggagctcgagcgactggctaaccgcagctccctcaacctgacccataataggacaaagagaagcaccgacggcaacaacgctactcatttgagcaacatggaatccgtgcacaacctggtgtatgcccagctgcagttcacttacgacaccctgagaggctacatcaatagagccttagctcagatcgcagaggcttggtgtgtggaccagcgaagaactctggaggtgttcaaggagttaagtaagatcaatccatccgccatcctgtctgctatctacaacaagcccattgccgccaggttcatgggagatgtgctcggcctggctagttgtgtcaccatcaaccagacctccgtgaaggtgctgcgggacatgaatgtgaaggagagccccggtcggtgttactccagaccagtggtgattttcaacttcgccaacagctcctatgtgcagtacggacagctcggagaggataacgagatcttgctcggcaatcacagaactgaggagtgtcagctgccatcactgaagatatttattgccgggaattccgcctacgaatacgttgactaccttttcaagagaatgatcgacctgagcagcatcagcaccgtcgacagcatgattgctctcgatatcgaccctctggagaacaccgactttagagtccttgagctgtattcacagaaggagctgaggagctccaatgtgttcgacctggaggaaatcatgagagagttcaactcttacaagcagcgggtgaagtacgtggaggataaggtagtggacccactcccaccatacctgaaaggactcgacgatctcatgagcggactgggcgcagccgggaaggctgttggcgtcgccatcggagcggtcggaggagcagtggctagcgtggtggagggcgtggccaccttcctgaagaaccctttcggcgcctttaccatcatcctggtggccatcgccgtggtcatcattacatatctgatttatacaagacagagaaggctctgcacccagcccttgcagaacctgttcccctacctggtcagtgccgacggtacaaccgtgaccagcggtagcaccaaggacacctccctgcaggcaccgccgagctacgaggagtccgtgtataacagtggaagaaagggccccggaccgcccagcagcgacgcatccaccgccgctcctccctacacaaatgagcaggcctatcagatgttgctggctctggcacgcctggacgccgagcagcgagctcagcagaacggcaccgattccctggatggacgcacaggcacacaggacaaggggcagaagcccaacctcctcgacagactgagacaccggaagaacggatacaggcatctgaaggactccgatgaggaggagaacgtt

SEQ ID NO: 161 - DNA, 2721 bp, Artificial Sequence
  Synthetic polypeptide
atggaatccaggatctggtgcctcgtggtctgtgtgaacttgtgcatcgtgtgcttgggtgccgccgtgagcagtagcagcaccagaggcaccagcgcaacacactcacaccacagctcccataccacttccgccgcccactccagatcgggctccgtgagccagagggtcaccagcagccagacggtgtcccacggagtgaatgaaaccatctacaacactactctgaagtacggagacgtcgtcggcgtgaataccactaagtacccctacagggtctgctctatggcccaaggcacagacctgatcagatttgaaagaaatatcgtctgtacctccatgaagcccatcaatgaggacttagacgagggcattatggtggtgtataaacgcaacattgtggcccacactttcaaggtcagagtgtatcagaaagtgctcaccttcaggcgtagctatgcctatatccacaccacttatctcctcggcagcaacaccgagtatgttgccccgcctatgtgggagattcaccatataaatagccatagccagtgctacagctcctattcgagagtaatcgccggaaccgttttcgtcgcctaccacagagactcgtacgagaacaagacaatgcagctgatgccagatgactattcgaacacccacagcacgagatatgtcaccgtgaaagatcagtggcacagcaggggtagtacatggttgtatagggaaacctgcaatctcaattgcatggtgaccatcaccaccgccagaagcaaatacccctatcatttcttcgctacctcgacaggagacgtggtggacatatctcccttttataatggcacaaatagaaatgctagctactttggagagaacgccgacaaattcttcatcttccctaactataccatcgtgagcgactttgggcgacctaacagcgccctcgagactcacaggctggtggctttcttagagagggctgatagtgttatctcttgggacattcaggatgagaagaacgtgacatgccagctgacattttgggaggctagcgagcgaaccatcaggtccgaggccgaggacagctaccatttctctagtgccaagatgaccgccaccttcttgtcaaagaagcaagaggtgaacatgtccgactctgcgctggactgtgtccgcgacgaggcaattaataaactgcagcagatctttaataccagctacaaccagacatacgagaagtatggcaacgtgagcgtcttcgaaaccacaggcggccttgtcgtcttttggcaaggcatcaagcagaagagtctggtggagctggaaagactcgccaaccggtcatccctgaatctgacccacaataggacaaagcgcagcaccgatgggaacaacgccacccacctgtcgaacatggagtcagtgcacaacctggtgtacgcccagctgcagttcacttatgataccctcagaggctacattaaccgcgcactggctcagatcgccgaagcatggtgcgtggaccagcggcgaaccctggaagtgtttaaagagctctccaagattaatcctagcgccatcctgagtgctatctacaataagcctatcgccgcaagatttatgggcgacgtgctgggactggcttcctgcgtgacaattaaccagacctccgtcaaggtgctgagggacatgaacgtgaaggagagccccggcagatgctatagccggccagtggtgatcttcaatttcgccaacagctcatacgtgcagtacggccagctcggggaggataatgaaatcctgctgggaaatcacagaaccgaggagtgtcagctgcccagtctgaagattttcatcgcaggcaacagtgcctatgaatacgtggactatctgttcaaacgcatgatcgatctgagctctatctccaccgtggactccatgattgccttggatatcgacccactggagaacaccgatttcagagtgctggagctgtacagccagaaggagctcaggtccagcaatgtgttcgacctggaggaaatcatgagagagttcaactcctacaaacagagagtcaagtacgtggaggacaaggtggtggatcccctgcctccctacctgaaggggctggacgacctgatgagtggcctgggagccgccggcaaagctgtgggagtggccatcggtgccgtcggaggggctgtggccagcgtcgtcgagggagttgccacattcctgaagaaccccttcggggccttcaccattatcctagtcgccattgccgtggtcatcattacctatctgatctacacgcggcagagacggctgtgcacccagcctttgcagaacctgttcccctatttagtgtccgctgacgggaccactgtgacaagcggaagcaccaaggacacatccctgcaggccccacccagctacgaggagtctgtttacaattctggccggaagggccccggccctccctcttctgacgcctccaccgcagcccctccttacacaaacgagcaggcttaccagatgctgttggctttggcccgtctggacgccgaacagagggcccagcagaatggcaccgactccttggacggccggacagggacccaggataagggtcagaagcctaacctactggatcggctccgccatcgcaagaatggctacagacatctcaaggacagcgacgaagaagagaatgtg

SEQ ID NO: 162 - DNA, 2721 bp, Artificial Sequence
  Synthetic polypeptide
atggaatcaagaatctggtgtctcgtggtgtgcgtgaacctgtgtatcgtctgtcttggcgccgccgtctcttcctcaagcacccggggtaccagtgccacccactcacatcactcctcccacactaccagcgccgcccacagcagatccggctccgtgtcccagcgggtgaccagcagccagaccgtgtcacacggcgttaatgaaaccatttacaacaccacactgaagtacggggacgtggtgggcgtgaacaccaccaagtatccctacagggtgtgcagcatggcccagggcaccgacctgattcggttcgagagaaacatcgtgtgcacatccatgaagcctatcaatgaggacctcgacgagggcatcatggtggtttacaagaggaacattgtcgcacacacatttaaggtgcgagtgtaccagaaggtgttaaccttcagaaggtcctacgcatacatccacaccacctacctcctgggctctaacacagaatacgtcgcccctcccatgtgggagattcaccacatcaacagtcacagccagtgctacagctcgtatagcagagttatcgctggcaccgtgttcgtggcttatcaccgcgacagctacgagaacaagacgatgcaacttatgcccgacgattactcaaacacgcactccactagatacgtgactgtgaaggaccagtggcacagtagaggcagcacctggctgtaccgggaaacatgcaatctcaattgtatggtcaccattaccaccgccaggtccaagtacccttaccacttcttcgccacctccactggcgacgtggtcgacatcagccccttctacaatggcaccaacaggaacgcctcttactttggggagaacgccgataaattctttattttccccaactacactattgtctccgactttggcagacccaactcagcattggaaacccacaggctcgtggccttcctggagcgggccgatagtgtgatcagctgggacatccaggatgagaagaacgtgacatgccagctgaccttctgggaggccagcgaacgaaccatccggtccgaggccgaggactcttatcacttctctagcgcaaagatgaccgccaccttcctgtctaagaaacaggaggtgaacatgagcgacagcgccctggactgcgtcagagacgaggcaatcaacaagctgcagcaaatcttcaacaccagctacaaccaaacctacgagaaatacggcaacgtcagcgtcttcgagactaccggagggctcgttgttttctggcagggcattaagcagaagtctctggtcgagctggaaaggctggccaatagaagctccctaaacctcactcacaacagaactaagagaagcaccgatggcaataacgccactcatctgagtaacatggagtctgttcacaacctggtgtatgcccagctgcagtttacttatgacacactgaggggctacatcaatcgagccctggcccagatcgccgaggcttggtgcgtcgaccagagaagaacactggaagtgttcaaggagctgagtaagattaatcccagcgccattctgtccgccatctacaataagccaatcgccgcaagattcatgggtgacgtgctgggcctggcctcctgcgtgacaatcaaccagacaagcgtgaaagtcctcagagacatgaacgtcaaggagtctcctggcaggtgttactcccggcccgtggtgatatttaatttcgccaacagcagttacgtgcagtacggacagctgggcgaggataacgagatactgctcggaaaccatagaacagaggagtgccaactgccctccctgaagattttcatcgccgggaacagcgcctatgagtatgttgactatctgttcaagcggatgatcgacctgagttctatcagcaccgttgactccatgattgctctcgatatcgatcctctggagaacaccgatttcagagtgctggaactctactctcagaaagagctaagaagctcgaacgtgttcgacctggaagaaatcatgagagagttcaactcctacaaacagagggttaagtacgtagaggataaggtcgtggaccctctgcctccataccttaagggattagatgatctgatgagcggcctgggcgctgccggaaaggccgtgggagtggccatcggcgcagtgggtggtgccgtggctagcgtcgtggaaggcgttgccacattcttgaagaacccattcggggccttcacaatcatcctggtggctatcgccgttgtgattatcacatatctgatctacactcgccagcggaggctctgcacccagcctctgcagaaccttttcccctacctagtgtccgctgatgggactacagtcactagcggcagcactaaggacacatccctgcaggctcctccatcttacgaggagagcgtgtataactccgggcgcaagggacctggccctcccagcagcgacgccagcacggcggctcctccctacaccaacgagcaggcataccagatgttgcttgcactggcccgtctggacgctgagcagagggcccagcagaatgggactgattccctggacggcagaaccggcacacaggataaaggacagaaaccgaatctgctcgacaggctgaggcaccggaagaatggatacaggcatctgaaggacagtgacgaggaggagaacgtg

SEQ ID NO: 163 - DNA, 2721 bp, Artificial Sequence
  Synthetic polypeptide
atggagtcaagaatctggtgcttggtggtgtgtgtgaacttgtgtatcgtgtgccttggagccgccgtgagcagcagctccaccagaggcaccagcgccacccacagccatcactcttcccacaccacaagcgccgcccactcgcggagcgggagtgtttcccaacgggtgacaagcagccagactgtgagccacggcgttaacgagacaatctacaacacaacactgaagtacggcgacgtggtgggtgtaaatactaccaagtatccttacagggtgtgctctatggcccagggtaccgacctgatcaggtttgagagaaacattgtttgcacaagcatgaagcccatcaatgaggacttggatgagggcatcatggtggtttacaagagaaatatcgtggcccacaccttcaaagtgagggtgtatcagaaggtgctgacctttagaaggagctacgcttatatccacacaacctaccttctgggcagcaacaccgagtacgtcgcaccacccatgtgggaaattcaccacatcaactctcactcccagtgctattccagctacagcagagtgatagccggcacagtcttcgtggcctaccacagggatagttacgagaataagacgatgcaactgatgcctgacgattactccaacacacacagcacccggtacgtcaccgtgaaggaccagtggcactccagaggtagtacttggctgtaccgggagacttgtaacctgaactgcatggtgacaattaccactgctcgaagcaagtacccttaccacttctttgccacctctaccggcgatgtcgtagacatatctcctttctataacgggaccaacagaaacgcttcgtacttcggcgagaacgctgacaagttcttcatcttcccgaactacactatagttagcgactttggtaggccgaacagcgccctggagacacaccgacttgtggccttcctcgagagagctgacagcgtgatctcctgggacatccaggacgagaagaacgtcacctgccagctgacattctgggaggcctctgagaggaccatcagatccgaggccgaggattcataccactttagcagcgctaagatgaccgctaccttcctgagtaagaagcaggaagtgaacatgtccgactcagccctcgactgcgtgagggacgaggccatcaacaagctgcagcagatcttcaacacctcctacaaccagacatatgagaagtatggtaacgtgagcgtgttcgagacaaccggcggactggtcgtgttttggcagggcataaagcagaagtctctggtcgagctggagaggctggcgaacaggagcagcctcaacctgacccataacagaaccaaacgcagcaccgacggcaacaatgctacccacctgtcaaacatggagagcgtccacaacctggtgtatgcccagctgcaatttacatacgacacgctgcgcggctacatcaatagagccctggcccagatcgccgaggcttggtgcgttgaccagcggcgtactctggaagtcttcaaggagctgagcaagatcaatcccagcgctatcctgagcgcgatctacaataaacctattgctgccagattcatgggagacgtgttggggctggccagctgcgtgacaatcaatcagaccagcgtgaaagtgctgagagacatgaatgtgaaggagtctcctggtaggtgctactcaaggcccgtcgtaattttcaatttcgccaacagttcctacgtgcagtacggacagctgggcgaagacaatgagatcctcctgggcaaccatcggacggaggagtgtcaactcccatcactgaagatctttatcgcaggcaattccgcctatgagtatgtggactatctgttcaagaggatgatcgacctgtccagcatcagcacagtggattcaatgattgcccttgacatcgaccctcttgagaataccgactttagagtgctggagctttatagccagaaagagctcaggagctccaatgtgttcgacctggaagagatcatgcgggagtttaacagctacaagcagagggttaaatatgtggaggacaaggttgtggatccactgccgccctacctgaaagggctggacgacctcatgtccggcctaggagccgcagggaaagccgtgggcgtggccatcggcgcagttggaggcgccgtcgcctctgtggttgaaggcgttgcgacctttctgaagaacccattcggcgccttcaccattatcctggtggccattgccgtggtcatcatcacctatctgatctacaccaggcaacgacgcctgtgcacccagcccctgcagaacctgttcccttacctggtcagcgccgatgggaccacagtgacctctggttctactaaagacaccagccttcaggcccctccatcctacgaggagtctgtgtacaatagcggcagaaagggccccggcccgcccagcagcgatgccagcaccgccgctcctccatacacgaacgagcaggcctatcagatgctgctggcccttgcccgcctggacgccgagcagcgtgctcagcagaatggcaccgattctctggacggccgaactggaacgcaagacaagggacagaagccaaacctgctggacagactgagacacaggaagaatggctacaggcatctgaaggattcagacgaggaggagaacgtg

SEQ ID NO: 164 - DNA, 2721 bp, Artificial Sequence
  Synthetic polypeptide
atggagagccggatctggtgccttgtggtgtgcgtgaacctttgcatcgtgtgcctcggcgccgccgtgagctcatcgagcacccggggcaccagcgccacccacagccaccacagcagccacaccaccagcgcggcccacagtcggagcggcagcgtgagccagcgggtgacctcctcccagaccgtctcccacggcgtgaacgaaaccatctacaacaccaccctgaagtacggcgacgtggttggggtaaataccactaagtacccctaccgggtgtgcagcatggcccagggcaccgacctgatccggttcgagcggaacatcgtctgtaccagcatgaagcccatcaacgaggacctggacgagggcatcatggttgtctacaagcggaatatcgtagcccacaccttcaaggtgcgggtgtaccagaaggtgctgaccttccggcggagctacgcctacattcacacgacttacctgctgggcagcaacaccgagtacgtggcgccgcccatgtgggagatccaccacatcaactctcactctcagtgctacagcagctacagccgggtgatcgccggcaccgtgttcgtggcctaccaccgggacagctacgagaacaagaccatgcagctgatgcccgacgactattctaacacacactccactaggtacgtgaccgtgaaggaccagtggcactccagaggcagcacctggctgtaccgggagacgtgcaacctgaactgcatggtgaccatcaccaccgcccggtcaaagtacccttaccacttcttcgccaccagcactggggatgtggttgacatcagccccttctacaacggcaccaaccggaacgccagctacttcggcgagaacgccgacaagttcttcatcttccccaactacaccatcgtgagcgacttcggccggcccaacagcgccctggaaacacaccggctggtggccttcctggagcgggccgacagcgtgatcagctgggacatccaggacgagaagaacgtgacctgccaactcacattttgggaggccagcgagcggaccatccggagcgaggccgaggactcctatcacttcagcagcgccaagatgaccgccaccttcctgagcaagaagcaggaggtgaacatgagcgattcggcattggactgcgtgcgggacgaggccatcaacaagctgcagcagatcttcaacaccagctacaaccagacctatgagaaatacggcaacgtgagcgtgttcgaaaccaccggcggactggttgttttctggcagggtatcaagcagaagagtttggtggagctcgagcgcctggcaaacaggagcagcctgaacctgacccacaaccggaccaagcggagcaccgacggcaacaatgcaacgcacctatccaacatggagtccgtgcacaacctggtgtacgcccagctgcagttcacctacgacaccctgcggggctacatcaaccgggccctggcccagatcgccgaggcatggtgcgtggaccagcggcggaccctggaggtgttcaaggagctttccaagatcaacccctctgccatcctgtctgctatctacaataagccaatcgcggcacgcttcatgggagacgtactgggcctggccagctgcgtgactattaatcagactagcgtcaaagtgctacgggacatgaacgtaaaggagagccccggccggtgctattctcggcccgtggtcattttcaacttcgccaacagttcctacgtgcagtacggacagttaggcgaggacaacgagattctgctgggtaaccaccggaccgaggagtgccaacttcccagtctaaagatatttatcgccgggaattccgcttatgagtatgtcgactacctgttcaagcggatgatcgacctgtccagtatcagcaccgtggacagcatgattgcactggatatcgaccctctcgagaacaccgacttccgggtgctggagctgtacagccagaaagagctgagatcaagtaatgtctttgacctggaggagatcatgcgggagttcaatagctacaagcagagggtgaaatatgtcgaagacaaggtagtagacccgctgcctccctacctgaaggggcttgacgacctcatgtcagggttaggggcagctggcaaggccgttggcgtcgccatcggcgcggtgggcggtgccgttgcctccgtggtcgaaggcgtcgctaccttcctcaagaaccccttcggcgccttcaccatcatcctggtggctattgcagttgtcatcattacctacctcatctacacccggcagcggaggctgtgcacccagcccctgcagaacctgtttccatacctggtgagcgcagacggaactaccgtgacgagcggatccactaaggacaccagcctgcaggcgcctccttcatacgaagagagtgtgtacaacagcggccggaagggccccggacctccgagtagcgacgcaagtaccgccgccccaccctataccaacgagcaagcttaccagatgctgctggcacttgctcggctggacgccgaacaacgcgcccagcagaacggaactgattctctggacggccggaccggcacccaggacaagggccagaagcccaacctgttggaccggctgcggcaccggaagaacggctatcgtcacctgaaagacagcgacgaggaggagaacgtg

SEQ ID NO: 165 - DNA, 2721 bp, Artificial Sequence
  Synthetic polypeptide
atggagagccggatctggtgcctagtggtgtgcgtgaacctctgcatcgtgtgcctaggcgccgccgtgagcagttctagtacccggggcaccagcgccacccacagccaccacagcagccacactacgtcagcagcgcatagtcggagcggcagcgtgagccagcgggtgacgtcttcccagacagtgtcccacggcgtgaacgaaaccatctacaacaccaccctgaagtacggcgacgtggtgggtgtcaatacaactaagtacccctaccgggtgtgcagcatggcccagggcaccgacctgatccggttcgagcggaatattgtgtgtaccagcatgaagcccatcaacgaggacctggacgagggcatcatggtggtatacaagagaaacattgtcgcccacaccttcaaggtgcgggtgtatcagaaggtgctgaccttccggcggagctacgcctacattcatacgacttacctgctgggcagcaacaccgagtacgtggccccgcccatgtgggagatccaccacatcaacagccactcccagtgctacagcagctacagccgggtgatcgccggcaccgtgttcgtggcctaccaccgggacagctacgagaacaagaccatgcagctgatgcccgacgactatagcaatactcacagcacacggtacgtgaccgtgaaggaccagtggcacagccgcggcagcacctggctgtaccgggaaacgtgcaacctgaactgcatggtgaccatcaccaccgcccggtcgaagtatccctatcacttcttcgccaccagcacgggcgatgtggttgacatcagccccttctacaacggcaccaaccggaacgccagctacttcggcgagaacgccgacaagttcttcatcttccccaactacaccatcgtgagcgacttcggccggcccaacagcgccctggaaacccaccggctggtggccttcctggagcgggccgacagcgtgatcagctgggacatccaggacgagaagaacgtgacctgccagcttacattctgggaggccagcgagcggaccatccggagcgaggccgaggacagttaccacttctcgagcgccaagatgaccgccaccttcctgagcaagaagcaggaggtgaacatgagcgacagtgctctggactgcgtgcgggacgaggccatcaacaagctgcagcagatcttcaacaccagctacaaccagacctatgagaaatacgggaacgtgagcgtgttcgagacaaccggcggcttagtagtgttctggcaggggatcaagcagaagagtttggtggagctcgagcggctggcgaacagaagcagcctgaacctgacccacaaccggaccaagcggagcaccgacggcaacaacgcaacgcacttatcaaacatggaaagtgtgcacaacctggtgtacgcccagctgcagttcacctacgacaccctgcggggctacatcaaccgggccctggcccagatcgccgaggcgtggtgcgtggaccagcggcggaccctggaggtgttcaaggagttgtcgaagatcaacccttctgccatcctgtcagcaatttacaataaacctattgccgcaaggttcatgggagatgtcctgggcctggccagctgcgtgaccataaaccagacaagcgtcaaagtcctccgggacatgaatgtgaaagagagccccggccggtgttacagtcgacccgtggtgatctttaacttcgccaattcttcttatgtgcagtacggacagctcggcgaggacaacgagatcctgctcggtaaccaccggaccgaggagtgtcagcttccctcactgaagattttcattgcggggaacagtgcatacgagtatgttgactacctgttcaagcggatgatcgatctgtctagtatcagcaccgtggacagcatgatcgctctggatatcgacccattggagaacaccgacttccgggtgctggagctgtacagccagaaggagcttcgcagcagtaatgtgtttgacctggaggagatcatgcgggagttcaattcttacaagcagcgcgtgaaatacgttgaggacaaggtggtcgatccgctgcctccctacctgaagggcctggatgatctcatgagcgggttaggggctgccggcaaggccgtcggcgttgccatcggcgcagtgggcggagccgtcgccagcgtggtggagggtgttgcaacgttcctgaagaaccccttcggcgccttcaccatcatcttggttgcaatcgcggttgttatcattacctaccttatctacacccggcaacggcggctgtgcacccagcccctgcagaacctgtttccatacttggtgagcgcggatgggaccaccgtgacttcaggttccaccaaggacaccagcctgcaggcgcctccctcatacgaggagtccgtatacaacagcggccggaaggggccaggtcctcctagctcggacgcaagtactgccgcaccgccttataccaacgagcaggcatatcagatgctgcttgccctggctcggctggacgccgaacagcgcgcccagcagaacggaacagattccctggacggccggaccggcacccaggataagggccagaagcccaacttgctggaccggctgcggcaccggaagaacggctataggcatctgaaggacagcgacgaggaggagaacgtg

SEQ ID NO: 166 - DNA, 2721 bp, Artificial Sequence
  Synthetic polypeptide
atggagagccggatctggtgcctagtggtgtgcgtgaacctatgcatcgtgtgcttaggcgccgccgtgagctcatcgtccacccggggcaccagcgccacccacagccaccacagcagccacacgacaagcgccgcccactcccggagcggcagcgtgagccagcgggtgacttcttcccagacagtgagccacggcgtgaacgagactatctacaacaccaccctgaagtacggcgacgtggtgggcgtcaacactaccaagtacccctaccgggtgtgcagcatggcccagggcaccgacctgatccggttcgagcggaacattgtgtgcaccagcatgaagcccatcaacgaggacctggacgagggcatcatggttgtgtacaagcgtaatatcgtcgcccacaccttcaaggtgcgggtgtaccagaaggtgctgaccttccggcggagctacgcctacatccatactacgtacctgctgggcagcaacaccgagtacgtggctcctcccatgtgggagatccaccacatcaactcccatagccagtgctacagcagctacagccgggtgatcgccggcaccgtgttcgtggcctaccaccgggacagctacgagaacaagaccatgcagctgatgcccgacgactattcgaacacccactcaaccagatacgtgaccgtgaaggaccagtggcattcacggggcagcacctggctgtaccgggaaacatgcaacctgaactgcatggtgaccatcaccaccgcccggagtaaatacccttatcacttcttcgccaccagcacgggcgacgtcgtagacatcagccccttctacaacggcaccaaccggaacgccagctacttcggcgagaacgccgacaagttcttcatcttccccaactacaccatcgtgagcgacttcggccggcccaacagcgccctggagacacaccggctggtggccttcctggagcgggccgacagcgtgatcagctgggacatccaggacgagaagaacgtgacctgccagctgacgttttgggaggccagcgagcggaccatccggagcgaggccgaagattcctatcactttagcagcgccaagatgaccgccaccttcctgagcaagaagcaggaggtgaacatgtctgattccgcgctggactgcgtgcgggacgaggccatcaacaagctgcagcagatcttcaacaccagctacaaccagacctatgagaagtatgggaacgtgagcgtgttcgagacaaccggcgggctggtcgtcttctggcaaggcattaagcagaagtccctcgtggagctggaacggctggccaaccgtagcagcctgaacctgacccacaaccggaccaagcggagcaccgacggcaacaatgctactcatctatcaaacatggaaagcgtgcacaacctggtgtacgcccagctgcagttcacctacgacaccctgcggggctacatcaaccgggccctggcccagatcgccgaggcctggtgcgtggaccagcggcggaccctggaggtgttcaaggagctaagtaagatcaacccctccgcaatcctgagcgccatctataacaagcctatcgccgcccggttcatgggcgatgtgctgggcctggccagctgcgtcaccatcaatcaaactagcgtgaaggtcctacgggacatgaacgtgaaagagagccccggccggtgctactcccggcccgtggtcatcttcaatttcgccaactcttcctatgtgcagtacgggcagctgggcgaggacaacgagattctgctgggtaaccaccggaccgaggagtgccagcttccctccctcaagattttcatagcaggcaattctgcctatgaatacgttgactacctgttcaagcggatgatcgatctctctagtatcagcaccgtggacagcatgattgcgttggacatcgacccgttagagaacaccgacttccgggtgctggagctgtacagccagaaagaactgcgttcaagcaacgttttcgacctggaggagatcatgcgggagttcaactcttacaagcagcgggtcaagtacgtcgaggataaggtcgtggacccgctgccgccctacctgaagggactggacgatctgatgtccggattgggagctgcaggaaaggccgtgggagtagccatcggcgctgttggaggggcagtggccagcgtggtcgaaggcgtcgcgacgttcctgaagaaccccttcggcgccttcacaataatcttggttgccattgctgtcgtcattattacatatcttatctacacccggcagagaagactgtgcacccagcccctgcagaacctgttcccttatttggtgagcgccgacgggacaaccgtcacctccggctcaacgaaggacaccagcctgcaggctccgccttcatatgaagagtcagtatataacagcggccggaaggggccaggtcctccatctagcgacgcatcaactgccgcacctccgtacaccaacgagcaggcataccagatgctgttggccctcgcacggctggacgccgagcaacgcgcccagcagaacgggacggactctttggatggccggaccggcacccaagacaagggccagaagcccaatttgctggaccggctgcggcaccggaagaacggctatagacatctgaaggacagcgacgaggaggagaacgtg

SEQ ID NO: 167 - DNA, 2721 bp, Artificial Sequence
  Synthetic polypeptide
atggagagccggatctggtgcctagtggtgtgcgtgaacctatgcatcgtgtgccttggcgccgccgtgagctcgtccagtacccggggcacctccgccacccactcccaccactcctcccacactacaagcgccgcccactcgcgctccggctccgtctcccagcgcgtcaccagttcccagaccgtgagtcacggcgtcaacgaaaccatctacaacaccaccctcaagtacggcgacgtcgtgggcgtgaatacaaccaagtacccctaccgcgtctgctccatggcccagggcaccgacctcatccgcttcgagcgcaacatcgtctgcacctccatgaagcccatcaacgaggacctcgacgagggcatcatggtcgtgtataagcgaaatattgtggcccacaccttcaaggtccgcgtctaccagaaggtcctcaccttccgccgctcctacgcctacattcacacaacctacctcctcggctccaacaccgagtacgtcgcccctcccatgtgggagatccaccacatcaacagtcacagccagtgctactcctcctactcccgcgtcatcgccggcaccgtcttcgtcgcctaccaccgcgactcctacgagaacaagaccatgcagctcatgcccgacgactatagcaatacacatagtacccgctacgtcaccgtcaaggaccagtggcacagcaggggctccacctggctctaccgcgagacttgcaacctcaactgcatggtcaccatcaccaccgcccgctcaaagtacccgtatcacttcttcgccacctccacgggagacgtggtggacatctcccctttctacaacggcaccaaccgcaacgctagctatttcggcgagaacgccgacaagttcttcatcttccccaactacaccatcgtctccgacttcggccgccccaactccgccctcgaaacccacaggcttgtggccttcctcgagcgcgccgactccgtcatctcctgggacatccaggacgagaagaacgtcacctgccagctcacattctgggaggcctccgagcgcaccatccgctccgaggccgaggattcgtaccactttagctcagcaaagatgaccgccaccttcctctccaagaagcaggaggtcaacatgagcgactctgctttggactgcgtccgcgacgaggccatcaacaagctccagcagatcttcaacacctcctacaaccagacttatgagaagtatggcaacgtctcggtgttcgagactacgggcggtctggtggtcttctggcaggggattaagcagaagtccctcgtcgagttggagagactcgccaaccgctcctccctcaacctcacccacaaccgcaccaagcgctccaccgacggcaacaacgccacgcacctctcaaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctcagtaagatcaacccaagtgcgatcctgtcggccatttacaataaaccgattgcagcccgcttcatgggtgacgtactcggcctcgcctcctgcgtgacgattaatcagaccagcgtcaaggtgcttcgcgacatgaatgtgaaggagagcccaggccgctgttacagtcggcccgtcgtcattttcaatttcgccaatagcagctatgtccagtacggccagctcggcgaggacaacgagatactccttggcaaccaccgcaccgaggagtgccagctgccgtctctgaagatattcatagccggcaacagcgcttatgaatacgtggactacctcttcaagcgcatgatcgacctctcctccatctccaccgtcgactccatgatcgcacttgatatcgacccactggagaacaccgacttccgcgttctggaactctactcccagaaggagctacggtcctccaatgttttcgacctcgaggagatcatgcgcgagttcaattcatacaagcaacgggtgaagtatgtggaggacaaggtcgtcgatcctctgcctccctacctcaagggtcttgatgatctcatgtccggcctcggcgctgccgggaaggcagtgggagtcgccatcggcgccgttggaggggccgtcgcctctgtggtggagggcgtggctaccttcctgaagaaccccttcggcgccttcaccattattctggtggccatcgcagtggttatcatcacgtaccttatctacacccggcagagaaggctctgcacccagcccctccagaacctctttccttatctcgtcagcgcagacggtacaacagttactagtggaagtaccaaggacacctccctccaggccccgccaagctacgaggaaagtgtttacaactccggccgcaagggccccggcccaccttcttccgacgcttccaccgctgctccaccatacaccaacgagcaggcctaccagatgctcctggcactggctcggctggatgccgagcagagggcccagcagaacggtaccgattccctcgacggccgcaccggcacccaggataagggccagaagcccaatttactagacagactgcgccaccggaagaacggctaccgccatctgaaggactccgacgaggaggagaacgtc

SEQ ID NO: 168 - DNA, 2721 bp, Artificial Sequence
  Synthetic polypeptide
atggagagccggatctggtgcctagtggtgtgcgtgaacctctgcatcgtgtgcttgggcgccgccgtgagtagttccagtacccggggcacctccgccacccactcccaccactcctcccacactacgagtgccgcccactcacgctccggctccgtctcccagcgcgtcactagttctcagacagtgtctcacggcgtcaacgagacaatctacaacaccaccctcaagtacggcgacgtcgtgggtgtgaatactactaagtacccctaccgcgtctgctccatggcccagggcaccgacctcatccgcttcgagcgcaacatcgtctgcacctccatgaagcccatcaacgaggacctcgacgagggcatcatggtcgtctacaagagaaatatagtggcccacaccttcaaggtccgcgtctaccagaaggtcctcaccttccgccgctcctacgcctacattcacactacctacctcctcggctccaacaccgagtacgtcgccccacccatgtgggagatccaccacatcaactctcacagtcagtgctactcctcctactcccgcgtcatcgccggcaccgtcttcgtcgcctaccaccgcgactcctacgagaacaagaccatgcagctcatgcccgacgactactcaaacactcacagcacccgctacgtcaccgtcaaggaccagtggcacagccgcggctccacctggctctaccgcgagacttgcaacctcaactgcatggtcaccatcaccaccgcccgctcgaagtatccgtaccacttcttcgccacctccacgggcgatgtggtcgacatcagtccattctacaacggcaccaaccgcaacgcttcatacttcggcgagaacgccgacaagttcttcatcttccccaactacaccatcgtctccgacttcggccgccccaactccgccctcgagacacaccgcctggtcgccttcctcgagcgcgccgactccgtcatctcctgggacatccaggacgagaagaacgtcacctgccagttgaccttctgggaggcctccgagcgcaccatccgctccgaggccgaggacagttaccatttcagtagtgccaagatgaccgccaccttcctctccaagaagcaggaggtcaacatgtcggactctgctcttgactgcgtccgcgacgaggccatcaacaagctccagcagatcttcaacacctcctacaaccagacttatgagaagtatggtaacgtctctgtgtttgagactacaggcggtcttgtcgtcttctggcagggtatcaagcagaagtccctcgtcgagctggaacgcctcgccaaccgctcctccctcaacctcacccacaaccgcaccaagcgctccaccgacggcaacaacgcaacacatcttagcaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctgagtaagatcaacccaagtgcaatcctaagcgctatttacaacaaacctatcgcagccaggttcatgggagacgtcctcggcctcgcctcctgcgtcaccattaatcagacgtctgttaaggttctccgcgacatgaacgtgaaagagtctccgggccgctgctacagcaggcccgtcgtcatcttcaatttcgccaattcttcatatgtccagtacggccagctcggcgaggacaacgagattctcttagggaaccaccgcaccgaggagtgtcagctacccagcctgaagatctttattgccggcaatagcgcttatgagtatgttgactacctcttcaagcgcatgatcgacctctcctccatctccaccgtcgactccatgatcgctctggatatcgaccctctggagaacaccgacttccgcgtgcttgagctctactcccagaaagagcttaggtcaagcaacgttttcgacctcgaggagatcatgcgcgagttcaactcatataagcaacgcgttaaatatgtagaggataaggtggttgatccacttcctccctacctcaagggtctggatgacctcatgtccggcctcggggcagcaggcaaggccgtcggcgttgccatcggcgccgtgggaggtgctgtggccagtgttgtcgagggcgtagccaccttcttaaagaaccccttcggcgcctttacaataatcctggtggccatcgctgtggttatcattacctatcttatctacaccaggcagcggaggctctgcacccagcccctccagaacctcttcccttacctcgtgagcgcggacgggacgaccgtcacatctggcagtacaaaggacacctccctccaggccccgcctagttatgaagagagcgtttacaactccggccgcaagggccccggtcctccctcctccgacgccagcaccgcagcgcctccatacaccaacgagcaggcctaccagatgctcttggccctggcccgactggatgccgagcagcgcgcccagcagaacggaaccgactccctcgacggccgcaccggcacccaggacaaaggccagaagcccaatctgctcgaccgcctgcgacaccgcaagaacggctatcggcaccttaaagactccgacgaggaggagaacgtc

SEQ ID NO: 169 - DNA, 2226 bp, Artificial Sequence
  Synthetic polypeptide
atgcggccaggacttcctagctacctaatcatccttgccgtgtgtcttttctcacacctcctctctagtaggtacggcgcagaggccgtgtccgagccactcgacaaggccttccaccttttgttaaacacctacggtcggccaatcagattcctccgcgagaacaccacccagtgcacgtacaattcgtctctccgcaacagcacagtcgtgagggagaacgctatatcattcaacttcttccagtcttacaaccagtattacgtgttccacatgccaagatgcctgttcgctggcccactggccgagcagttccttaaccaggtggatctgacagagactctggagagataccaacagaggctgaacacctacgcactggtgagcaaggatctggcctcctacaggagcttcagccaacagctgaaggcccaggacagtctgggcgagcaaccaaccaccgtacctccacctattgacttatcaatacctcacgtgtggatgcctcctcagaccactcctcacggctggaccgaatcccacaccacctccggcctgcacaggcctcatttcaaccagacctgtattctcttcgacggacacgacctgcttttcagcaccgtcacgccatgcttgcaccagggcttctacctgatcgacgagctcaggtatgtgaagatcactctgaccgaggacttcttcgtggttactgtgagcatcgatgacgataccccaatgttactgatcttcggccacctgcctagggtgctgttcaaggcaccataccagagagacaatttcatcctgagacaaaccgagaagcacgagctgctggtgctggtcaagaaggaccagctgaataggcactcatacctgaaggacccagatttcctggacgctgcccttgatttcaattacctggacctgtccgccctgctgagaaacagcttccacagatacgccgtggatgtgctgaagtcaggcagatgtcagatgttggaccgccgaaccgttgagatggccttcgcctacgcgctggccctgttcgccgccgctcggcaggaggaagctggcgcacaggtgagcgtgccgagggctctggaccgacaggctgctctgctacagattcaggaattcatgatcacctgcctgtcacagactccgcctcggactaccctgctgctgtatcctacagcagtggacctggcaaagagagctctttggacccctaaccagatcaccgatatcaccagcctcgtccggctggtctacattctgtctaagcagaatcagcagcacctgatccctcagtgggctctcagacagatcgccgatttcgccctgaagctgcacaagacccacctggcttctttcctgagcgctttcgccagacaggaactgtacctgatgggatcgcttgtgcacagcatgctggtgcacacaactgagaggagagagattttcattgtggagactggcctgtgcagcctggccgagctgtcccatttcacccagctcctcgctcatccgcaccacgagtacctctccgacctctataccccttgctcctcttccggccggcgcgatcacagcctggaaagactcactagactgttcccagacgctaccgtgccggctactgtcccggcagcactgagcatcctgagcactatgcagccttctacgctggaaaccttcccggacctgttctgcctgccactcggagaaagcttctctgccctgacggtgagtgagcacgtgtcgtacatcgtgacaaaccagtacctgatcaagggtatcagctacccagtgtccacaactgtggtgggccagagcctgatcatcacccagaccgatagccaaacaaagtgcgaactgacaagaaacatgcataccactcattccatcactgtggccttaaacatctccctggagaactgcgccttctgtcagtccgccctgctggagtacgatgatacccagggcgttattaatatcatgtacatgcatgatagcgacgatgtgcttttcgccctggacccatacaacgaggtggtggtgtccagccctagaacccactacctcatgctgctgaagaacggcacagtgctggaggtgaccgacgtggtggtggacgctacggacagcaggctgctgatgatgagcgtgtacgccctgagcgccattatcggaatatacctgctgtacaggatgttgaagacctgt

SEQ ID NO: 170 - DNA, 2226 bp, Artificial Sequence
  Synthetic polypeptide
atgcggccgggactccctagctacctcatcatcctcgccgtgtgccttttctctcaccttttgagctccagatacggcgccgaagcggtgtccgagcctctcgacaaggccttccacctccttctcaacacatacggcagaccgatccggttcttgagggagaacactacccaatgcacatataacagtagcctgcggaatagcactgtggtgcgggagaacgccatcagcttcaatttcttccagagctacaatcagtattacgtgttccacatgcctagatgtctgttcgcgggccctctggcagagcagttcctgaaccaggttgatctcacagagacactggagagataccagcaaagactgaacacctacgctctcgtctccaaggacctggccagctataggagcttcagccagcagctgaaggcccaggattccctgggagagcagccaaccaccgtcccgccgccaatcgacctctctatcccacacgtgtggatgcctccacaaaccacaccacacggatggactgagtcccataccaccagcggactgcacaggcctcacttcaatcagacctgcattttgttcgacggccacgacctcctgttcagcactgtgaccccgtgtctgcatcagggcttctacctgattgacgagctgaggtacgtcaagattacgctcaccgaagacttcttcgtggtcacagtgagtatcgatgacgacacccctatgctgctcatcttcggccatctgcctagggtgctgttcaaggccccttaccagagagataatttcatcttgcggcagactgagaagcacgaactgctggtactcgtgaagaaggaccagctgaaccgccactcttacttaaaggatccagacttcctggatgcagcacttgacttcaactatctcgacctctctgccctgctgaggaacagcttccaccggtatgccgtggacgtgctgaagagtggacggtgtcagatgctggaccgcagaacagtggaaatggcgttcgcgtatgctctggccctattcgcggccgcaagacaggaggaggccggcgctcaggtgtccgtccctagagctctggacaggcaggccgccctgctgcaaattcaggagttcatgataacttgcctgagccaaacccctccgagaacaacactgctgctgtatccaacagccgtagatctggccaagcgggccctttggactcctaaccagatcaccgatattacctccctggtgagactggtgtacattctgtccaagcagaaccagcagcacctgatcccgcagtgggccctgagacagatcgctgatttcgccttgaagctgcacaagactcatctggcctccttcctgagtgctttcgcccgccaggaactgtatctgatgggctctcttgtccattccatgctggttcataccacggagagaagggagatcttcatcgtggaaaccggcctttgctccctcgctgagctgagccatttcactcagctgctcgcccacccgcaccacgagtacctgtcagacctttatactccgtgctcctccagcggcaggagggaccacagcctggaacggctcacaagactgttcccggatgctaccgtgcctgctactgtgccagccgccctgagcatcctttccaccatgcagccttccacactggagactttccctgacctgttctgcctgccacttggcgaaagtttcagcgccctgaccgtgtccgaacatgtgagctacatcgtgactaaccagtacctgatcaagggcatcagctacccggttagcaccactgtcgtcggacagtcactgatcatcactcagaccgactcccagaccaagtgcgaactgaccagaaatatgcacacaacccatagcatcaccgtggccctgaacattagcctggagaactgtgccttctgccagagcgccctcctcgagtacgacgatacccagggtgtgataaacattatgtatatgcacgacagtgacgacgttctgttcgcactggacccttacaacgaagtggtcgtttcctctcctcggacccattacctgatgctgctgaagaacggcaccgtgctagaggttactgatgtggtagtggacgccacagacagcagactgctgatgatgagcgtgtacgccctgagcgccattattggcatctacctgctgtacaggatgctgaagacatgt

SEQ ID NO: 171 - DNA, 2226 bp, Artificial Sequence
  Synthetic polypeptide
atgcggccgggactcccttcctacctcatcatccttgccgtgtgtcttttctcacacctcctcagcagccgctacggcgccgaggccgtgtcagagccacttgacaaggccttccatcttttgttgaacacctacggcagacctattcggttcctgagagagaacacaacccagtgcacctataacagctctctgcgcaactccacagtggttagagagaatgccatcagcttcaacttcttccagagttacaaccagtattacgtgttccatatgcctaggtgcctgttcgctggcccgttagccgaacagttcctcaaccaggtggatctgaccgaaacactggaaaggtaccagcagcggctgaatacatacgccttggtgtcaaaggatcttgcttcctacagaagcttcagccagcagctgaaggcccaggacagccttggagagcagccaaccaccgtgcctcctcctattgacctgagcatccctcatgtgtggatgcctcctcagaccacccctcacggctggactgagagccataccacgtccggcctgcacaggcctcacttcaatcagacctgcatcctgttcgacggccacgatctgcttttcagcaccgtcaccccttgcctgcaccagggattctacctgatcgacgagctccggtatgtgaagattacactgaccgaggacttcttcgtggtgaccgtgtccatcgacgatgacaccccaatgctgctgatcttcggccacctgccgagagtcctgttcaaggccccataccagagagacaacttcatcctgcggcagaccgagaagcacgaactgctagtgctggtgaagaaggatcagctgaaccggcactcctacctgaaggaccctgacttccttgacgccgcactcgacttcaactacctggacctcagtgctctactgaggaactctttccaccggtacgccgtggacgtgctgaagtctggaagatgccagatgctggataggaggacagtggagatggcgttcgcgtacgccctggccctgttcgccgccgccagacaggaggaggccggcgcacaggtcagcgtcccaagggccctggaccgccaggctgccctgctgcagattcaggaattcatgatcacctgtctcagccagacccctccgagaacaaccctgctgttgtacccgaccgcagtggatctggctaagagggccctgtggaccccaaaccagattaccgacatcacctctctggtgagactggtgtacatcctgtccaagcagaaccaacagcacctcattccacaatgggccctgaggcaaatcgccgatttcgctctcaagttgcataagacccatctggcctcattcctcagcgccttcgcaagacaggagttgtatctcatgggctccctcgtgcatagcatgctggtgcacacaaccgagcgcagagaaattttcatcgttgaaaccggactgtgcagcctcgccgagttgtctcatttcacccagctgctggctcatcctcaccatgagtatctttccgacctgtacaccccgtgcagcagcagcggccgcagggatcacagcctcgagagactgacaagactgttcccagacgccaccgtgcctgccacagtgccagccgcgctgtccatcctgagcacaatgcagcctagcacactggagactttcccagatctgttctgtcttccactgggcgagagcttcagcgccctgaccgtgagcgagcacgtgagctacatagtgaccaaccaatatttgattaagggcatctcctaccctgtgagcaccacagtggtgggccagtctctgatcatcacacaaaccgacagtcagacgaagtgcgagctgactagaaacatgcacacgacccacagcataaccgtggcactcaacatctccctggagaattgcgccttctgccagagcgccctcctggagtacgacgacactcaaggagtgatcaacatcatgtacatgcacgatagcgatgacgtgctgttcgccctggacccatacaatgaagtggtggtgtccagcccacggacccactacctgatgctcctcaagaacggcacagtgctggaggttacagacgtggtggtcgacgctaccgatagcagacttcttatgatgtccgtgtacgccctgagcgccatcatcggaatctatctgctttacaggatgctgaagacttgc

SEQ ID NO: 172 - DNA, 2226 bp, Artificial Sequence
  Synthetic polypeptide
atgcggccaggcctcccttcgtaccttatcatcttggccgtgtgtcttttctctcacctactctcctcaaggtacggcgccgaggccgtgagtgagccgctagacaaggccttccacctattacttaacacctacggccggcctatccgattcctccgggagaataccacacagtgtacatacaactctagcctgcgcaacagcactgtggtcagggagaacgccatcagcttcaatttcttccagagttataaccagtactacgtgttccacatgccaagatgcctgttcgccggacctcttgccgagcagttcctgaaccaggtggatctgaccgagacactggagagataccagcaaaggctcaatacctacgctttagtgagcaaggaccttgcttcttacagatctttctcacaacagcttaaggcgcaggacagcctcggcgagcagcctaccaccgtgcctcctcctattgacttgagcatcccacacgtatggatgcctccacagacgacaccacacggctggaccgaatcccatacaaccagcggactccaccggcctcatttcaatcagacctgcatccttttcgacggccatgacctgctattctctaccgtcaccccgtgcctgcaccagggcttctaccttatcgacgaactgagatacgtcaagatcacgctgaccgaagacttcttcgtcgttacagtcagcatcgacgacgatacccctatgctgctgatattcggccaccttcctagagtcctgttcaaggcaccgtaccagagggacaacttcatcctgagacagacagagaagcacgagctcctggtgctggtgaagaaggatcagctgaatagacacagttacctgaaggatccagacttcctggacgccgcactggacttcaactatctggatctgagcgccctgcttcgcaatagcttccatagatacgctgtggacgtgctgaagtctggccggtgtcagatgctggatcgtaggaccgtggagatggccttcgcctacgcactcgctctgttcgccgccgctagacaggaggaggccggagcccaagtgagtgtgcctcgggcactggacagacaggcagccttactgcagatccaggagttcatgattacctgcctgtctcagactccaccacggaccacccttctgctgtatcctaccgcggttgatctggctaagagggccctgtggacccctaaccagatcactgacatcaccagcctcgtgaggctggtgtacattcttagcaagcagaaccagcagcacctaatacctcagtgggccctgcggcagatcgccgacttcgccctgaagctgcacaagacccacctggcaagcttcctgtccgccttcgcccgccaggagctgtacctcatgggaagtctggtacactccatgctggtgcacaccaccgagagaagagagatcttcatcgtagaaaccggactctgctcactggccgaattgtcacacttcacccagctgctggcccatcctcatcacgagtatctgtccgacctgtacaccccttgcagctctagcggcaggcgggaccattccttggagaggctgaccaggctgttcccggatgccaccgttccagcaacagtgcctgcagccctgagcattctgtcaacaatgcagcctagcaccctcgaaactttcccggatctgttctgcctgcctcttggtgagagcttcagcgccctgaccgtgtccgagcatgtgtcttatatcgtaaccaatcagtacctgatcaagggcatcagctaccctgtgtccacaactgtcgtgggccaaagcctcatcataacccagaccgattcccagacaaagtgtgaactgacccgcaacatgcacaccactcacagcattactgtggccctgaacatctccctggagaactgtgccttctgtcagagcgcgcttctggagtatgatgacacccagggtgtgattaatatcatgtacatgcacgacagcgacgatgtgctgttcgcgctggatccttacaatgaggtggtcgtgagctcccctagaacccactatctcatgctgttaaagaacggcaccgtcctggaggtgacagacgtggtggttgatgccaccgacagcaggctgctgatgatgagcgtttatgccctgagcgccatcatcggcatttacctcctgtacaggatgttaaagacttgt

SEQ ID NO: 173 - DNA, 2226 bp, Artificial Sequence
  Synthetic polypeptide
atgcggccaggactccctagctacctcattatcctcgccgtgtgccttttctctcacctcttaagctcccggtacggcgccgaagccgtgagcgagccgcttgacaaggctttccacctcctccttaacacctacggcagacctattagattcctgagagagaacaccacccagtgtacatataattctagcctgcggaactccaccgtagtgagggagaatgccattagcttcaacttcttccagagctacaaccagtactatgtgttccatatgccgagatgtctgttcgctggacctctcgcagaacagttcttgaaccaggtggatctgactgaaactctcgagcggtaccagcaaagactgaatacctatgccttggtaagcaaggatctggctagctacaggagcttctcccagcagctcaaggcccaggactcccttggcgaacagcctaccaccgtccctcctccaattgacctgagcattccgcacgtgtggatgcctcctcagaccaccccacacggctggacagagtctcataccaccagcggactgcatagaccgcatttcaaccagacttgcatcctgttcgatggacatgatctcctgttctctacagtgactccatgcctgcaccagggcttctacctgatcgatgagctcagatacgtcaagatcaccttgaccgaagatttcttcgtggtcacagtgagcattgacgacgacaccccaatgcttctgatattcggtcacctgcctagggtcctcttcaaggctccataccagagagacaatttcatccttagacagaccgagaagcacgagctgctcgtgctggtgaagaaggatcaactgaacagacatagctacctaaaggatccggatttcctggacgccgctctggacttcaactacctcgacctcagcgccctgctgaggaacagcttccaccggtatgcagtcgatgttctcaagtccggcagatgccagatgctggaccgtagaactgtggagatggccttcgcctatgctctggccctgttcgccgccgcacgccaggaagaggctggagcccaggtgagcgtcccacgggctctggacagacaggctgctctgctgcagatccaagagttcatgattacctgtctgagccagacccctcctagaaccaccctcctcctctatccgaccgctgtggacctggccaagagagccttgtggacccctaatcagattactgacatcacaagcctggtcagactggtgtatatcctgagcaagcagaatcagcagcacctcattccacagtgggcgctgcggcagatcgctgatttcgccctgaagctgcacaagacccacctggccagcttcttgagcgcattcgcacggcaggaactctacctgatgggctctctggtgcacagcatgctcgtccacaccacagaacggcgagagatattcatcgttgagacaggcctgtgctctctggccgagttgtcccacttcacccaactgctggctcaccctcatcacgagtacctcagcgacctgtacaccccttgctcctccagcggtagacgggatcacagcctggaaagactgaccagactgttcccagacgccacggtccctgcaaccgtgcctgccgctctttcaatcttgtccaccatgcagcctagtacactggaaacattccctgacctcttctgcctgcctctcggagagtccttctcagccctgaccgtgagcgaacacgtgtcctacatcgtgaccaaccagtacctgatcaagggcatctcctaccctgtgtcgaccaccgtcgtgggccagagcctgatcattacacagacggactctcagaccaagtgcgagttgacacggaacatgcacaccacacacagcatcactgtggccctgaatattagcctcgagaactgcgccttctgccagagtgccctgctagagtatgatgatacacagggcgtgattaatatcatgtatatgcacgactctgatgacgtcctgttcgccctggacccatacaacgaggtggttgtgagctcccctcggacccactatctgatgctgctcaagaacggcactgttctcgaggtgacagatgtggtggtcgatgccacagattctcggctgctgatgatgagcgtgtacgctcttagcgccatcatcggaatctacctcctgtacaggatgctgaagacttgt

SEQ ID NO: 174 - DNA, 2226 bp, Artificial Sequence
  Synthetic polypeptide
atgcggccgggcctcccgtcttacctcatcatcttggccgtgtgcctcttctcccacctcttgagctcccggtacggcgcagaggccgtgtcagagcctctcgacaaggccttccatttgctccttaacacatacggcaggccaatcaggttcctgcgagagaataccacacaatgcacctacaactccagcttgaggaatagcaccgtggtgcgggagaacgccatctccttcaatttcttccagtcctacaatcagtattatgtgttccatatgcctaggtgtctcttcgcaggcccacttgccgaacaattcctgaaccaagtggacctgacagagacactggagagataccagcaacggctgaatacctacgccttggtgagcaaggatctcgccagctacagatctttctcacaacaactgaaggcccaggattctctcggtgagcagccaacgactgtgcctcctccaattgacctgtctatcccacatgtgtggatgccacctcagactacccctcacggatggacagagtctcataccactagcggcctgcacaggcctcacttcaatcagacctgtatcctcttcgacggtcacgatctgttgttcagcaccgtgaccccatgcctgcatcagggcttctacctgattgacgagctgagatatgtgaagataacactgaccgaggatttcttcgtggtcaccgtgagcatagacgacgacacaccgatgctcctgatcttcggccatctgccacgagttctgttcaaggcaccttatcagagagacaacttcatcttgaggcaaacagagaagcacgagcttctcgtgctggttaagaaggaccagctcaacaggcatagctacctgaaggacccagatttcctggacgccgctctggatttcaattatctggacctttctgctctgctgagaaacagcttccatagatacgccgtggacgtccttaagtctggccgctgccagatgctggatagacggactgtcgagatggcattcgcctacgctctggctctgttcgccgccgccaggcaggaggaggctggagcccaagtgtcagtgcctagggctctggatagacaagccgccttgctccagatccaggagttcatgattacctgtctgagccagaccccaccaagaaccacgttactgctgtaccctaccgctgtggacctggctaagcgagccctctggacgcctaatcaaatcaccgacatcaccagcttagtcagactggtgtacattctgtctaagcagaaccagcagcacttgattccacagtgggccctgagacagattgccgacttcgccctgaagctccataagacccatctggcgtccttcctgagcgccttcgccagacaggagctctacctgatgggcagcctggttcattccatgctggtccatacaacggagagaagagagatcttcatcgtggagacaggactgtgctctttggccgaactttcccacttcactcagctgctggcgcaccctcatcacgagtacttatcggacctgtacaccccttgcagcagcagcggaaggagggaccattctctcgaaaggctgacaagactgttccctgacgccaccgtcccagccacagtgcctgccgcactgagcatcctcagcacaatgcagccaagcactctggagactttcccggacttgttctgcctgccgctgggcgagtccttcagcgcccttacagtgtcagagcatgtgtcctacatcgtgaccaatcagtacctgatcaagggaatcagctaccctgtgtctacaaccgtggttggccagtccctcatcatcacccagacagatagccaaactaagtgcgaactgactagaaacatgcacacaacccactccatcacagtggccctgaacatcagcctcgagaattgcgccttctgccagagcgcactgttggagtacgacgatactcagggcgtgattaacatcatgtacatgcatgatagcgacgatgtgctgttcgccctggacccttataacgaggtggtggtgagtagtcctaggacccattaccttatgctgctgaagaacggaactgttctggaggttaccgacgtcgtcgttgacgctaccgactcacgcctgctcatgatgtctgtgtatgccctgtctgccatcatcggcatctacctgctgtataggatgctgaagacttgc

SEQ ID NO: 175 - DNA, 2226 bp, Artificial Sequence
  Synthetic polypeptide
atgcggcccggccttcccagctacctcatcatcctcgccgtgtgcttgttcagccaccttctaagcagccggtacggcgccgaggccgtgagcgagcccctcgacaaggccttccacttgttattgaacacctacggccggcccatccggttcctgcgggagaacaccacccagtgcacctacaacagcagcctgcggaacagcaccgtggttcgggagaatgccatcagcttcaacttcttccagagctacaaccagtactacgtgttccacatgccccggtgtcttttcgccggaccgctggccgagcagttcctgaaccaggtggacctgaccgaaactctggagcggtaccagcagcggctgaatacctatgccctggtgagcaaggacctggcctcataccggagcttcagccagcagctgaaggcccaggacagcctgggcgagcagcccaccaccgtgcctccacccatcgacctgagcatcccgcacgtgtggatgcctccacagaccacacctcacggctggaccgagagccacaccaccagcggcctgcaccggccccacttcaaccagacctgcatcctgttcgacggccacgacctgctgttcagcacagttaccccttgccttcatcagggcttctatcttatagacgagctgcggtacgtgaagatcacactcaccgaggacttcttcgtggtgaccgtgagcatcgacgacgacactcctatgctcctcatcttcggccatcttccccgggttctgttcaaggctccataccagcgggacaacttcatcctgcggcagaccgagaagcacgagttgctggtgctggtgaagaaggaccagctgaaccggcattcgtaccttaaggaccccgacttcctggacgccgccctggacttcaactacctagatctcagcgccctgttgaggaatagcttccaccggtacgccgtggacgtgttaaagagcggccggtgccagatgctggatcggcggaccgtggagatggccttcgcctacgcgctggccttgttcgctgccgcccggcaggaggaggccggcgcccaggtgagcgtaccgcgggcactcgatcggcaggccgctctgctgcagatccaggagttcatgatcacctgcctgagccagacccctccgcggaccaccttactgctttaccccactgcagttgacctggctaagcgcgcactctggacccctaaccagatcaccgacatcaccagcctggtgcggctggtgtacatcctgagcaagcagaaccagcaacacctgataccacagtgggctctgagacagatcgccgacttcgccctgaagctgcacaagacccatctggccagcttcctgtccgctttcgcacgacaggagctgtacctgatgggatcactcgtgcacagcatgctcgtgcataccaccgagcggcgggagatcttcatcgtggaaacaggcctgtgttcactagccgaactgagccacttcacccaacttttggcccatccacaccacgagtatttgtcggacctgtacaccccttgttcctcttccggaaggcgggaccactccctggaacggctgacccggctgttccccgacgcaaccgtaccggccacggttccagctgccttaagcatcttaagtaccatgcagcccagcacactggaaaccttcccagatctgttctgcctgccgctgggtgagtctttcagcgctctcaccgtgtccgagcacgtgagctacatcgtgacaaatcaatatctgattaagggcatcagctacccagtgtcaactacggtggttggccagagcttgattataacccagaccgactcgcagactaagtgcgagcttacgagaaacatgcacacaacccacagcatcaccgtggccctgaacataagtctggagaactgcgccttctgccagtctgccttgctcgagtatgatgacacccagggcgtgatcaacatcatgtacatgcatgacagcgacgatgttctcttcgcgttggatccatacaacgaggtggtggtgtccagtccgagaactcactatctgatgctcctaaagaacggcaccgtgctggaggtgaccgacgtcgtggtcgatgccacggactccagactgcttatgatgagcgtgtacgccctaagcgccatcatcggcatctatctcctgtatcggatgcttaagacctgc

SEQ ID NO: 176 - DNA, 2226 bp, Artificial Sequence
  Synthetic polypeptide
atgcggcccggccttcccagctacctcatcatcctcgccgtgtgcttgttcagccacttgcttagcagccggtacggcgccgaggccgtgagcgagcccttggacaaggccttccacttactcctcaacacctacggccggcccatccggttcctgcgggagaacaccacccagtgcacctacaacagcagcctgcggaacagcaccgtggtgcgtgagaacgccatcagcttcaacttcttccagagctacaaccagtactacgtgttccacatgcccaggtgccttttcgccggaccactggccgagcagttcctgaaccaggtggacctgaccgaaacactggagcggtaccagcagaggctgaacacatacgccctggtgagcaaggacctggcctcctaccggagcttcagccagcagctgaaggcccaggacagcctgggcgagcagcccaccaccgtgccgccacccatcgacctgagcatcccacacgtgtggatgccaccacagaccacccctcacggctggaccgagagccacaccaccagcggcctgcaccggccccacttcaaccagacctgcatcctgttcgacggccacgacctgctgttctcgaccgtcaccccttgcttgcaccagggcttctatctgatagacgagctgcggtacgtgaagatcaccttgaccgaggacttcttcgtggtgaccgtgagcatcgacgacgacacacctatgctgctcatcttcggccatttaccccgggttctgttcaaggcaccataccagcgggacaacttcatcctgcggcagaccgagaagcatgagcttctggtgctggtgaagaaggaccagctgaaccggcactcatatctgaaggaccccgacttcctggacgccgccctggacttcaactacctggatttaagcgccctgctccgtaactctttccaccggtacgccgtggacgtgttaaagtcaggccggtgccagatgttggaccggcggaccgtggagatggccttcgcttacgcattagccctcttcgcagccgcccggcaggaggaggccggcgcgcaggtgagcgtgcctagagcgttggatagacaggcggccttgctgcagatccaggagttcatgatcacctgcctgagccagactcctccacggaccacattgctgctctaccccaccgccgttgacctggcaaagcgggcgctctggactccgaaccagatcaccgacatcaccagcctggtgcggctggtgtacatcctgagcaagcagaatcagcagcacctgataccacagtgggcactacgccagatcgccgacttcgccctgaagctgcacaagacccacctggccagcttcctgtctgctttcgcaaggcaggaactgtacctgatgggctctctagtgcacagcatgctcgtccataccacagagcggcgggagatcttcatcgtggagactggcctgtgctctcttgcggaactgagccacttcacccagctcctagcccacccacaccacgagtacctttctgacctgtacaccccgtgctcatcaagtggacggcgggaccactcgctggaaagactcacccggctgttccccgacgctactgtgccggcaactgtgcctgcggctctctctatattatctaccatgcagcccagcacactcgaaaccttccctgatctgttctgcctgcctctaggagagagcttctctgcccttacagtgtccgagcacgtgagctacatcgtgacaaaccaatacctcattaagggcatcagctaccctgttagtactaccgtcgtaggccagagcctaattatcacccagaccgactcccagacaaagtgcgaattaacgcgcaacatgcacacaacccacagcatcaccgtggccctgaacattagcctcgagaactgcgccttctgccagagtgccttgcttgagtatgatgatacccagggcgtgatcaacatcatgtacatgcacgacagcgacgatgtgctgttcgcactcgacccctacaacgaggtggtcgtaagcagtccaaggacccattatttgatgctgcttaagaacggcaccgtgctggaggtgaccgacgtggtggtagacgctacagactcccggctgcttatgatgagcgtgtacgcgctcagtgcgatcatcggcatctacctgctttatcggatgctaaagacctgc

SEQ ID NO: 177 - DNA, 2226 bp, Artificial Sequence
  Synthetic polypeptide
atgcggcccggcttgcccagctacttgatcatcttggccgtgtgcttgttcagccacttacttagcagccggtacggcgccgaggccgtgtccgagcccctcgacaaggccttccacctcctcctcaacacctacggccgccccatccgcttcctccgcgagaacaccacccagtgcacctacaactcctccctccgcaactccaccgtcgtgcgggagaatgccatctccttcaacttcttccagtcctacaaccagtactacgtcttccacatgccccgctgcctcttcgccggacctctcgccgagcagttcctcaaccaggtcgacctcaccgagacgctcgagcgctaccagcagaggttgaatacctatgccctcgtctccaaggacctcgcctcctaccgctccttctcccagcagctcaaggcccaggactccctcggcgagcagcccaccaccgtgcctccaccaatcgacctctccatcccgcacgtctggatgcctccccagaccactccgcacggctggaccgagtcccacaccacctccggactgcatcgccctcacttcaaccagacctgcatcctcttcgacggccacgacctcctcttcagtaccgtgacgccatgcctgcaccagggcttctacctcatcgacgagctccgctacgtcaagatcacccttaccgaggacttcttcgtcgtcaccgtctcgattgacgacgacacaccaatgctcctcatcttcggccacctcccgcgcgtgctgttcaaggcgccctaccagcgcgacaacttcatcctgaggcagaccgagaagcacgagctgctcgtcctcgtcaagaaggaccagctcaaccgccactcctacctcaaggaccccgacttcctcgacgccgccctcgacttcaactacctcgatctgagtgctctgctgaggaattcattccaccgctacgccgtcgacgtcctcaagtccggccgctgccagatgctcgaccgccgcaccgtcgagatggccttcgcttacgcgctggcactcttcgctgccgcccgccaggaggaggccggcgcccaggtcagtgtgccaagagcactggatagacaggccgcacttttgcagatccaggagttcatgatcacctgcctctcccagactccgcctcgcaccacgttgttgttgtaccccacagcagtcgatctggctaagagagccttatggacacctaaccagatcaccgacatcacctccctcgttcggctggtctacatcctctccaagcagaatcagcagcacctgatccctcagtgggcactccgtcaaatcgccgacttcgccctcaagctccacaagacccacctggcgtctttcctcagtgcattcgctaggcaggagctgtacctgatgggcagtctcgtccactccatgctggtgcacaccacggagcgccgcgagatcttcatcgtcgagactggcctctgtagtttagccgagctcagtcacttcacccaactgctcgcccaccctcaccacgagtaccttagtgacctctataccccttgctctagttccggtcgccgcgaccacagcctggaacgtctgacccgcctcttccccgacgctacagtaccagcaaccgtgccagcggccctgtctatcctgtctaccatgcagccctccaccttggagacgttcccagatctgttctgcctccctctaggcgaatcgttctctgcactcacggtcagcgaacacgtctcctacatcgtcacaaaccagtatctgataaagggcatctcctacccagtgtcgaccactgttgtcggccagtccctcatcatcacacagactgattctcagactaagtgcgagttgacacggaacatgcatactacacattctatcaccgttgctttaaacataagcctggagaactgcgccttctgccagtccgctctgctcgagtacgacgatacgcagggcgtcatcaacatcatgtacatgcacgactccgatgacgttctgttcgcactggacccctacaacgaggtcgtcgtctcctctcctaggactcactacttaatgctgttgaagaacggcaccgtcctcgaggtcaccgacgtggtcgtcgatgctacagacagccgactgctcatgatgtccgtgtacgctctctccgccatcatcggcatctacctgctctaccgcatgctcaagacctgc

SEQ ID NO: 178 - DNA, 2226 bp, Artificial Sequence
  Synthetic polypeptide
atgcggcccggcctacccagctaccttatcatcttagccgtgtgcttgttcagccacttgctcagcagccggtacggcgccgaggccgtgtccgagcccctcgacaaggccttccacctcctcctcaacacctacggccgccccatccgcttcctccgcgagaacaccacccagtgcacctacaactcctccctccgcaactccaccgtcgtcagagagaatgccatctccttcaacttcttccagtcctacaaccagtactacgtcttccacatgccccgctgcctcttcgccggcccactcgccgagcagttcctcaaccaggtcgacctcaccgaaactctcgagcgctaccagcagcggctgaatacgtatgccctcgtctccaaggacctcgcctcctaccgctccttctcccagcagctcaaggcccaggactccctcggcgagcagcccaccaccgtccctcctccaatcgacctctccatcccacacgtctggatgcctccccagaccactcctcacggctggaccgagtcccacaccacctccggcctccacaggccacacttcaaccagacctgcatcctcttcgacggccacgacctcctcttcagcacagtgacgccatgtctgcatcagggcttctacctcatcgacgagctccgctacgtcaagatcactctgacggaggacttcttcgtcgtcaccgtctctatagatgacgacaccccaatgctcctcatcttcggccacttgcctcgcgtgctgttcaaggctccctaccagcgcgacaacttcatcctccgccagaccgagaagcatgaattactcgtcctcgtcaagaaggaccagctcaaccgccactcctacctcaaggaccccgacttcctcgacgccgccctcgacttcaactacctggatcttagcgccctgctgcgtaacagcttccaccgctacgccgtcgacgtcctcaagtccggccgctgccagatgctcgaccgccgcaccgtcgagatggccttcgcctatgctctggccctgttcgctgccgcccgccaggaggaggccggcgcccaggtttccgttcctcgggctttagacagacaggctgccctgcttcagatccaggagttcatgatcacctgcctctcccagacgccaccacgcaccacactgttgctgtacccgacagcagtggacctggcaaagagggcactctggactccaaaccagatcaccgacatcacctccctcgtccgcctcgtctacatcctctccaagcagaaccagcaacacctgatacctcagtgggctctgcggcagatcgccgacttcgccctcaagctccacaagacccatttggcctccttcctgagtgccttcgctagacaggagctgtacctgatgggctccctggtgcactccatgctggttcacaccacagagcgccgcgagatcttcatcgtcgagacaggcctctgttcattggcagaactctcgcatttcacccagctgctggcccacccgcaccacgagtatctgagtgacctctacacaccatgcagttcgtcaggaaggcgcgaccacagcctggagcgactgacccgcctcttccccgacgcaacagtccctgctactgtccctgccgcgctgagtattttatcaacgatgcagccctccacgctcgaaaccttccctgacttgttctgcctccctcttggagagagtttcagtgccctgaccgtgtcagagcacgtctcctacatcgtcacgaaccagtatcttatcaagggcatctcctacccagtatcgactacagtggttggccagtccctcatcatcacccagactgacagtcaaactaagtgcgagcttactagaaacatgcacacaacccactccatcaccgttgcattaaacatcagcctcgagaactgcgccttctgccagagcgctctgctggagtacgacgacacacagggcgtcatcaacatcatgtacatgcacgactccgacgacgtcctgttcgcgcttgatccctacaacgaggtcgtcgtgtccagtccacgaactcattacctcatgctgcttaagaacggcaccgtcctcgaggtcaccgacgtggtcgtcgatgctaccgactcccgcctcctcatgatgtccgtttacgcactctctgcgatcatcggcatctacttactatatcgcatgctcaagacctgc

SEQ ID NO: 179 - DNA, 834 bp, Artificial Sequence
  Synthetic polypeptide
atgtgcagaagaccagactgcggattcagcttctccccaggcccagtgatcttactttggtgctgcctcctccttccgattgtgagcagtgccgccgtgagcgtggctcctaccgcggccgagaaggtgccggccgagtgcccagagctcacccgaaggtgccttctgggcgaggttttcgagggagacaagtacgagtcttggctccggcctctggtcaacgtgacgggcagagacggccctttgagccagctcatcagatacagaccagtaacacctgaggccgccaattccgtcctgctggatgaggccttcctggacaccctcgccctcctttacaataacccagaccagctgagagccctgttgacccttctcagcagcgacaccgctccacggtggatgaccgtcatgagaggctatagcgagtgcggagatggcagccctgccgtctatacctgcgttgacgacctgtgcaggggctacgatttgacaaggctcagctacggcagatctatattcacagagcatgtgctgggcttcgagctggtgccgccatccctgttcaacgtggtggtcgctataaggaacgaggccaccagaacaaatcgcgccgtgagactgccggtgtccacggcagccgcacctgagggcattacactgttctatggcctctacaacgccgtgaaggagttctgtttgcggcaccagctggacccaccactgctcagacacctggataagtactacgctggcctgcctccggagctgaagcaaacacgtgtgaatctgccagcccactctcggtacggaccgcaggccgtggacgcccgg

SEQ ID NO: 180 - DNA, 834 bp, Artificial Sequence
  Synthetic polypeptide
atgtgcaggaggccagactgcggcttctcattcagcccaggcccagtcatcctcctttggtgttgcctccttctccctatagttagcagtgccgccgtgagcgtggcccctacagccgcggagaaggtgccagcggagtgcccggagttaaccagacgttgcctcttgggcgaggtgttcgagggcgataagtatgagtcctggctgcggcctctggtgaacgtgaccggcagagacggacctctgtcccagctgatcagatacagaccagtgacccctgaagccgcaaacagcgtgctgctggacgaggccttcctggacaccctggccctgttatacaacaaccctgaccagcttcgcgcgctgcttacactgctgagcagcgataccgccccaagatggatgactgtgatgaggggatatagcgagtgtggcgacggcagccctgccgtctacacctgtgtggacgacctctgcagaggctatgacctgaccagactgtcatacggccgaagcatcttcaccgagcacgtcttaggattcgagctggtgcctccaagcctcttcaatgtggtggtggccattcggaacgaggctaccagaaccaaccgggcggtgcgtcttccagtttctacagccgccgccccggaaggaattaccctgttctacggcctgtacaacgctgtcaaggagttctgcctgagacaccagctggatccaccgctgctgcgccacttggacaagtactatgcgggcctccctcctgagctcaagcagacgagggtgaacctccctgctcactcacgttatggaccacaggccgtggacgctaga

SEQ ID NO: 181 - DNA, 834 bp, Artificial Sequence
  Synthetic polypeptide
atgtgcagaaggccagactgcggcttcagcttctctccaggaccagtgatcctcctctggtgctgccttctcctccctattgtgtcctccgccgccgtgtccgtggccccaaccgccgccgagaaggtgccagcggagtgcccagagctcaccaggcgctgtctgctgggcgaggtgttcgagggcgataagtacgagagttggctgaggccgttggtgaacgtgacgggcagggacggcccgctaagtcagttaataaggtaccggccagtgaccccggaggccgccaacagcgtgctgctggatgaggccttcttggacaccctggccctgttgtacaacaacccagaccagctgagagccctgctgactctgttgagcagcgacaccgccccaagatggatgaccgtgatgagaggctatagcgagtgcggcgatggcagccctgccgtgtacacgtgcgtggacgatttgtgtagaggctacgacctcaccagactgagctacggcagaagcatcttcactgagcatgtgctgggattcgagctggtgcctcctagcctgttcaatgttgtggtggctatacgcaacgaggccacaagaacaaacagggccgtaagactcccagtgagcaccgctgcagcccctgagggaatcacgctgttctacggcctctacaacgctgtgaaggagttctgtctgaggcaccaactggacccacctctgcttagacacctggataagtactacgccggcctcccacctgaactgaagcagaccagggtgaatcttcctgcacactcaaggtatggcccacaggccgtggatgccagg

SEQ ID NO: 182 - DNA, 834 bp, Artificial Sequence
  Synthetic polypeptide
atgtgcaggcggccagactgcggcttcagcttctcaccgggcccagtcatcttgttgtggtgctgcctcctcctccctatcgtaagctcggcagccgtcagtgtggccccaaccgccgccgagaaggttccagccgagtgtccagaactcacaaggcggtgcctgctgggcgaggtcttcgagggcgacaagtatgaaagctggctcaggccacttgtcaatgtgacaggcagagacggcccactgagccagcttatccggtatagacctgtcactcctgaggccgctaacagcgtgcttctggacgaggctttcctggacactctggctctgctttacaacaacccagaccagctgagagccctgctgaccctgctgagcagcgatacagccccaaggtggatgacagttatgaggggatacagcgagtgtggcgacggaagcccagccgtgtatacctgcgtggatgacctgtgcagaggctacgacctgacccgcctctcctacggaagatccatcttcaccgagcacgtgctaggattcgagctcgtccctcctagcctgttcaatgtggtggtggccatcagaaacgaggccactcggaccaatagagcagtgagactgccagtgagcaccgcggccgcaccagagggtatcacactgttctacggcctgtacaacgccgtgaaggagttctgtctgcgtcaccagctggacccacctctgcttagacatctggataagtactatgccggcctgcctcctgaactcaagcagacccgtgtgaatctgcctgcccactccagatacggccctcaggccgtggacgcaagg

SEQ ID NO: 183 - DNA, 834 bp, Artificial Sequence
  Synthetic polypeptide
atgtgtagacgaccagactgcggcttctctttctctccaggcccggtgatcttactctggtgttgtttgctccttcctatcgttagtagcgccgccgtgagcgtggctccgacagccgccgagaaggtgccagccgagtgcccagagctcaccagaagatgtctgctgggcgaggtcttcgaaggcgacaagtacgagtcttggctgaggcctctcgtgaatgttaccggcagggacggcccactgagccagctgattaggtaccggccagtgaccccggaagccgccaacagcgtgctgctggatgaagccttcctggacaccctggccctgctgtacaacaatcctgaccagctccgggccctgctgaccctcctcagcagcgacactgcccctcggtggatgacagtcatgagaggctactccgaatgtggagacggcagccctgccgtctacacctgtgtggacgacctctgtaggggctacgacctgacaagactgtcctatggcagaagcattttcaccgagcatgtgcttggcttcgagctggtgcctccatccctgttcaacgtggttgtggccattagaaacgaggccaccagaaccaacagggccgtgcggctgccagtgagtacagccgctgctccagagggcattaccctgttctacggcctttacaatgccgtgaaggagttctgtctgcgccatcagctggaccctcctctgctgagacacctggataagtattacgcgggcctgcctccagaactgaagcagacccgcgtcaacctgccagctcatagccgttacggcccgcaagcagtggacgcccga

SEQ ID NO: 184 - DNA, 834 bp, Artificial Sequence
  Synthetic polypeptide
atgtgccgaagaccggactgcggcttcagcttcagcccaggcccggttatcctcctctggtgctgcctccttctcccaatcgtgagcagcgccgccgtgagcgtggcgcctaccgccgcggagaaggtcccagccgagtgcccagaattgacgaggagatgcttgctgggcgaagtgttcgagggcgataagtatgagagctggctgcggcctctggtcaacgtgaccggccgcgacggcccactgtcccagctgatcaggtacagaccagtgaccccagaggctgctaacagcgtgctgctggatgaggctttcctcgacacgctggctctcctgtacaacaatccggatcagctcagagccctgctcacactgctgtccagcgacaccgctccaaggtggatgacagtgatgcggggctactcagagtgcggcgacggtagccctgcggtgtatacatgtgtggacgacctgtgcagaggctacgacttaaccaggctgtcctacggtagatccatcttcactgagcacgtgctgggcttcgagctggtgccacctagcctgttcaatgtcgtggtagccatccggaacgaggctaccagaacaaatcgggccgtgaggctcccagtgagcaccgccgccgctcctgagggcatcactctgttctacggactttacaacgccgtcaaggagttctgcctgcggcaccagctcgatccacctctgctgagacacctggacaagtactacgccggccttccgcctgagctgaagcagaccagagtcaacctgcctgcccatagcagatacggcccacaggctgtggatgccaga

SEQ ID NO: 185 - DNA, 834 bp, Artificial Sequence
  Synthetic polypeptide
atgtgccggcggcccgactgcggcttcagcttcagccccggccccgtgatcctattgtggtgctgcctacttttgcccatcgtgagcagcgccgccgtgagcgtggctcctaccgccgccgagaaggtgcccgccgagtgccccgagctaacccggcggtgccttcttggcgaggtgttcgagggcgacaagtacgagagctggctgcggcccctggtgaacgtgaccggccgggacggccctctgagccagctgatccggtaccggcccgtgacaccagaggccgccaacagcgtgctgctggacgaggccttcctggacaccctggccctgctgtacaacaaccccgaccagctgagagctctgctgacgctgctgtcaagcgacaccgcgccacggtggatgaccgtgatgcggggctacagcgagtgcggcgacggcagccccgccgtgtacacctgcgtggacgacctgtgcaggggctatgacctgacccgtctgagctacggccggagcatcttcaccgagcacgtgctgggcttcgagctggtgcctcccagcctgttcaacgtggtggtggccatccggaacgaggccacccggaccaaccgggccgtgcggctgcccgtgagcaccgcagcagccccagaaggcatcaccctgttctacggcctgtacaatgccgtgaaggagttctgcctgcggcaccagctggacccacctcttctcaggcacctggataagtactacgccggcctgcctcctgaactgaagcagacccgggtgaacctgcccgcccacagccggtatggcccacaggccgtggacgcccgg

SEQ ID NO: 186 - DNA, 834 bp, Artificial Sequence
  Synthetic polypeptide
atgtgccggcggcccgactgcggcttcagcttcagccccggccccgtgatcctcctctggtgctgcctcttgttgcccatcgtgagcagcgccgccgtgagcgtggctcctaccgccgccgagaaggtgcccgccgagtgccccgagctcacccggcggtgccttctgggcgaggtgttcgagggcgacaagtacgagagctggctgcggcccctggtgaacgtgaccggccgggacggccctctgagccagctgatccggtaccggcccgtgactccagaggccgccaacagcgtgctgctggacgaggccttcctggacaccctggccctgctgtacaacaaccccgaccagctgagggcccttctgaccctgctcagcagcgacaccgccccacggtggatgaccgtgatgcggggctacagcgagtgcggcgacggcagccccgccgtgtacacctgcgtggacgacctgtgcaggggctacgacctgaccaggctgagctacggccggagcatcttcaccgagcacgtgctgggcttcgagctggtgccgcccagcctgttcaacgtggtggtggccatccggaacgaggccacccggaccaaccgggccgtgcggctgcccgtgtcgacagccgccgcccctgagggcatcaccctgttctacggcctatataacgccgtgaaggagttctgcctgcggcaccagctggacccgcccctgcttcgccacctggacaagtattacgccggcctgcctccggagctgaagcagacccgggtgaacctgcccgcccacagccggtacggccctcaggccgtggacgcccgg

SEQ ID NO: 187 - DNA, 834 bp, Artificial Sequence
  Synthetic polypeptide
atgtgccggcggcccgactgcggcttcagcttcagccccggccccgtgatcctcctttggtgctgcttgctcttgcccatcgtgagcagcgccgccgtctccgtcgctcctaccgccgccgagaaggtccccgccgagtgccccgagctcacccgccgctgcctcctcggcgaggtcttcgagggcgacaagtacgagtcctggctcagacctctcgtcaacgtcaccggccgcgacggcccactctcccagctcatccgctaccgccccgtcacaccggaggccgccaactccgtcctcctcgacgaggccttcctcgacaccctcgccctcctctacaacaaccccgaccagctccgagccctgctgaccctgctgtcctccgacaccgctcctcgctggatgaccgtcatgcgcggctactccgagtgcggcgacggctccccagctgtgtacacctgcgtcgacgacctctgcagaggctacgacctgacgcgcctctcctacggccgctccatcttcaccgagcacgtcctcggcttcgagctcgtgcctccctccctcttcaacgtcgtcgtcgccatccgcaacgaggccacccgcaccaaccgcgccgtccgcctccccgtcagcacagccgctgcaccagagggcatcaccctcttctacggactgtacaacgccgtcaaggagttctgcctccgccaccagctcgacccacctctgctgaggcatctggacaagtattacgccggcctcccaccagagctgaagcagacccgcgtcaacctccccgcccactcccgctacggaccacaggccgtcgacgcccgc

SEQ ID NO: 188 - DNA, 834 bp, Artificial Sequence
  Synthetic polypeptide
atgtgccggcggcccgactgcggcttcagcttcagccccggccccgtgatcctcctctggtgctgccttttgctccccatcgtgagcagcgccgccgtctccgtcgctcctaccgccgccgagaaggtccccgccgagtgccccgagctcacccgccgctgcctcctcggcgaggtcttcgagggcgacaagtacgagtcctggctcagacctctcgtcaacgtcaccggccgcgacggcccactctcccagctcatccgctaccgccccgtcaccccagaggccgccaactccgtcctcctcgacgaggccttcctcgacaccctcgccctcctctacaacaaccccgaccagctcagggcccttctaaccctgctgtcctccgacaccgcccctcgctggatgaccgtcatgcgcggctactccgagtgcggcgacggctccccggccgtgtacacctgcgtcgacgacctctgcagaggatacgacctcacccggctctcctacggccgctccatcttcaccgagcacgtcctcggcttcgagctcgtcccaccctccctcttcaacgtcgtcgtcgccatccgcaacgaggccacccgcaccaaccgcgccgtccgcctccccgtcagcacagccgcagccccagagggcatcaccctcttctacggcctgtataacgccgtcaaggagttctgcctccgccaccagctcgacccgcctctgctgaggcacctggacaagtattacgccggcctccctcctgagctgaagcagacccgcgtcaacctccccgcccactcccgctatggaccacaggccgtcgacgcccgc

SEQ ID NO: 189 - DNA, 2094 bp, Artificial Sequence
  Synthetic polypeptide
atggagagcagaatttggtgcttggtggtgtgtgttaacctctgcattgtttgcctcggcgcagcagtgtctagcagctctactcggggaacatccgcaacccacagccaccatagctcacacaccaccagcgccgcccactccagatccggtagcgtgagccagcgggtgactagcagccagactgtgtcccatggcgtcaacgagacaatctacaacaccaccctgaagtacggcgacgtcgtgggcgtgaacacaacgaagtacccttacagggtgtgtagcatggctcagggcaccgacttgatccggttcgagagaaatattgtatgcaccagcatgaagccaattaacgaggatctggacgaaggcatcatggtagtgtataagagaaacatagttgcacacactttcaaggtgagggtctaccagaaggtgctgaccttccgccgaagctatgcttacatccatactacctacctgctcggttctaacaccgagtatgtggcacctccaatgtgggagatccaccacatcaattctcatagccagtgttacagctcttacagccgggtgatagccggcaccgtcttcgtggcctaccatagagattcatacgagaacaagaccatgcagctgatgccagacgactacagcaacacccattccaccaggtatgtgacagtcaaggaccaatggcactcacgcggctccacctggctgtacagggagacttgcaacctcaattgcatggtgaccatcaccaccgcccgcagcaagtacccgtaccacttcttcgccaccagcaccggagatgtcgtggacatcagccctttctataacggcactaacagaaacgccagttacttcggagagaatgccgacaagttcttcatcttcccgaactacactattgtgagcgatttcggtcgccctaactccgccctggagacacaccgcctggttgccttcctggagagagccgattccgtgatcagctgggacatccaggacgagaagaatgtgacctgtcagctcactttctgggaggcctccgagaggactatccggagcgaggccgaggactcataccatttcagcagcgccaagatgaccgccaccttcctgtcaaagaagcaggaggtgaacatgtcagatagcgctctggactgtgtgcgcgacgaggctattaacaagctgcagcagatcttcaatacctcctacaatcagacctacgagaagtatggtaacgtgtcagtattcgagacaactggcggcctcgtggtgttctggcagggaatcaagcagaagtccctggtggagcttgaaagactcgccaaccggagcagcctgaacctgacccacaacaggacaaagagatctacagatggtaacaacgccacccatctgagcaacatggagtccgtgcacaacctggtgtacgcccagctccagttcacatacgacaccctgagaggctacattaatagagccctcgcccaaatcgcagaggcctggtgcgtggaccagaggcgaaccctggaggtgttcaaggaattgagcaagatcaatccaagcgccatcttgagcgcaatctataacaagccgattgcggccagattcatgggcgacgtgttgggcctggcctcctgcgtcactatcaaccagacctctgtcaaggtgctcagagatatgaacgttaaggagtccccaggcagatgctatagcagacctgtcgtgattttcaatttcgccaactcaagctacgtgcagtacggccagctcggcgaagataacgagatcctgctgggcaaccacagaaccgaagagtgccagctgccttccctgaagattttcatcgctggcaactccgcttacgagtacgtggattacctgttcaagagaatgatcgacctcagcagcatcagcaccgtggacagcatgatcgccttagacattgaccctctggagaacacagatttcagggtgctggaactatactctcagaaggagctccggtctagcaacgtgttcgatctggaggagatcatgcgggagttcaattcctacaagcagcaccaccaccatcatcac

SEQ ID NO: 190 - DNA, 2094 bp, Artificial Sequence
  Synthetic polypeptide
atggagtcaagaatctggtgtcttgtggtgtgcgtgaacttgtgtatcgtgtgtttgggcgcagccgtgtcctcaagcagcactagaggcactagcgccacccactcccatcatagctcacacaccacaagcgccgcccactctaggtcaggcagcgtgtctcagcgcgtgacctctagccagactgtgagtcacggagtcaatgaaaccatctacaacacaacactgaagtacggagacgtcgtgggcgtgaatacaaccaagtacccatacagggtgtgcagcatggctcagggcactgacctcatcagattcgagcggaacattgtgtgcacctcaatgaagcctatcaacgaggatttggatgaaggcatcatggtcgtgtacaagagaaacatcgtcgctcataccttcaaggtgagagtgtatcagaaggtgctgaccttcagacgtagctacgcttacattcacaccacctacctgctgggcagcaacaccgagtatgtggctcctcctatgtgggagatacatcacatcaacagccattctcagtgctatagttcttatagcagggtcatcgccggcaccgtcttcgtggcctaccatagagatagctacgagaacaagaccatgcagttgatgccggacgattacagcaatacccatagcactaggtacgtgactgtgaaggaccagtggcactcccggggtagcacctggctttacagggaaacctgcaatctgaactgcatggtgactattaccaccgccaggagcaagtatccttaccacttcttcgctacatctactggagacgtggtcgatatctctcctttctacaatggcacaaacagaaatgcttcatatttcggcgagaatgccgacaagttcttcatcttcccaaactacaccattgtgtccgacttcggaagacctaattccgccctggaaacccatagactggtcgcattcctggaaagggccgactccgtcatttcatgggacatccaggatgagaagaacgtcacctgtcagctcacattctgggaagcgagcgaaagaacaattcgcagcgaagccgaggacagctatcatttcagcagtgctaagatgaccgccactttcctgtctaagaagcaggaggtgaacatgtccgacagcgccttggattgcgtgagagacgaagctattaacaagctgcagcagatcttcaacacctcctacaaccagacttacgagaagtatggcaatgtgagtgtgttcgagacaaccggcggcctggtagtattctggcagggcatcaagcagaagtcactggtggagcttgagaggctggccaatagatccagcctgaacctgacccacaaccggacaaagagatctaccgacggaaacaacgccactcatctttccaatatggagagcgtgcacaacctggtgtacgcgcagctccagttcacctacgacacactgaggggctacataaacagggccctggcacagatcgccgaagcctggtgcgtggaccagagaaggaccctggaggttttcaaggagctgagcaagattaatccgtccgctatcctgagcgcaatatacaataagccaatcgccgccagattcatgggcgacgtgttgggactggccagttgcgtcacaataaaccagacctctgtaaaggtcctgagggacatgaatgtcaaggagagcccgggcaggtgctacagccgtcctgtggtgattttcaacttcgctaattcatcttacgtccagtacggccagctgggcgaagacaatgagatcttactgggcaaccataggactgaggagtgccagctgccgagtctgaagattttcatagccggcaatagcgcatatgaatatgtagactacctgttcaagaggatgattgacctctctagcatctcgaccgtggacagcatgatcgccctcgacatcgaccctctggagaacacagacttccgggtcctcgaactgtacagccagaaggagcttaggagctccaacgtgttcgatcttgaggagatcatgagggagttcaatagctataagcaacatcaccaccatcatcac

SEQ ID NO: 191 - DNA, 2094 bp, Artificial Sequence
  Synthetic polypeptide
atggagagcagaatttggtgtctcgtggtgtgtgttaatctctgcatcgtgtgccttggcgccgccgtgtccagcagctccaccaggggcaccagcgcaacacacagccaccactctagccacacaaccagcgccgcccactctcgttcaggctccgtttcacagagggtgacctcctctcaaaccgtgtctcatggagtgaatgaaaccatttataacacaacactgaagtatggcgacgtggtgggcgtcaacaccaccaagtatccttaccgggtttgttcaatggcccagggcaccgatctcatcagattcgagcgaaatatcgtgtgtacatccatgaagcctatcaacgaagacctggacgagggaattatggtcgtgtacaagagaaatattgtggcccacactttcaaggtgagagtgtaccagaaggtgttgacattcaggcggtcctacgcctacatccacaccacttatctgttgggatccaacacagagtacgtcgcaccgcctatgtgggaaatacatcacatcaattcccattctcagtgctattctagctactccagagtgatcgccggcaccgtgttcgtggcctaccaccgcgatagctacgagaataagaccatgcagctgatgcctgacgattacagcaacactcattccacacgctacgtgaccgtgaaggatcagtggcacagccgcggcagcacctggctgtaccgggaaacctgcaacctgaactgcatggtgacaataacaaccgcacgtagcaagtacccataccacttcttcgccacctccaccggtgacgtggtcgacatcagccctttctacaatggcaccaacagaaatgcctcctacttcggcgagaacgccgacaagttcttcatcttccctaattatacaattgtgagcgacttcggcaggcctaacagcgccctggagactcatcgcttggtggctttcctggaacgcgctgacagcgtcatctcttgggatatccaagatgagaagaacgtgacctgccagctgaccttctgggaggccagcgagaggacaatcagaagcgaagccgaggactcttaccatttcagttcagctaagatgaccgccaccttcctgagcaagaagcaggaagtgaatatgtccgattccgctcttgactgcgtcagggacgaagccatcaacaagctccagcagattttcaatacttcttataatcagacctatgagaagtacggcaatgtcagcgtcttcgagacgaccggcggcctggttgtgttctggcaaggaatcaagcagaagtcactggtggagcttgagcggctggccaacagatccagcttgaacctgacccataatcgcaccaagcggagtaccgatggcaacaacgccacacacctcagcaatatggaaagcgtgcacaaccttgtgtacgctcagctgcagttcacctacgatacccttagaggctacatcaacagagccctggcccagatcgcagaggcatggtgcgtggaccagcggcggaccctggaggtgttcaaggagctctccaagatcaacccatccgccattctctccgccatctacaacaagcctattgccgctcggttcatgggcgatgtgctgggactggccagctgcgtgaccatcaaccaaacctcagtgaaggtgctcagagacatgaacgtcaaggagtctccaggcagatgttacagcagacctgtggtgatcttcaacttcgccaattcttcctacgtgcagtacggccaactgggtgaagacaacgagattctgttaggcaaccacaggactgaggagtgtcagctgccgagcctgaagatcttcatcgctggaaacagcgcatacgagtacgtggactacctcttcaagaggatgatcgacttgtcatctatctccacggttgattccatgatcgccttggacatcgatcctctggagaataccgacttcagagtgctggagctctacagccagaaggagcttaggtctagcaatgtgttcgacctggaggagatcatgagggagttcaatagctataagcagcatcaccaccaccatcac

SEQ ID NO: 192 - DNA, 2094 bp, Artificial Sequence
  Synthetic polypeptide
atggagagcagaatctggtgcctcgtggtgtgcgtgaacctctgtatcgtctgcttaggagccgccgtgagcagtagctctaccagaggcacatccgccacccacagccaccactcttcacacaccaccagcgccgcccactccagatcaggcagcgtatcccagagagtgaccagcagccagaccgtgtcacatggagtgaatgaaacaatttacaacaccaccctcaagtacggcgacgtagtgggagtgaacactactaagtacccataccgcgtgtgtagcatggcccagggcaccgatctgatccgattcgagagaaacatcgtttgcaccagcatgaagcctatcaacgaggacctggatgagggcatcatggtggtgtacaagaggaacatcgtggcccacacgttcaaggttagggtgtaccagaaggtgctgactttccgaagaagctatgcctacattcacactacatacctgctcggcagtaacaccgagtacgtggcgccaccgatgtgggaaatacaccatattaattctcatagtcagtgctattccagctacagcagggtgatcgccggaaccgttttcgtggcttatcatagagattcctacgagaacaagaccatgcagctgatgccagacgactatagcaacacgcatagcacccgctacgtgaccgtgaaggaccagtggcattcaagaggatccacctggctctacagagagacatgcaatctgaactgcatggtgaccatcaccaccgcccggtccaagtacccttatcacttcttcgccacaagcaccggcgatgtggtggacatttccccattctacaacggaaccaaccggaacgcctcttacttcggcgagaacgccgacaagttcttcatcttcccaaattataccatcgtgagcgacttcggaagacctaacagcgccctggagacacacagactggtggccttcctcgagcgcgccgactccgtgatctcctgggacatccaggacgagaagaacgtgacttgtcagctgacattctgggaggccagcgaacggaccatcagaagcgaggctgaagactcctaccacttcagctccgccaagatgaccgccactttcctgtcaaagaagcaggaggtgaacatgagcgacagcgccttggattgcgtgagagatgaggccatcaacaagcttcaacagatcttcaacacatcctacaaccagacgtacgagaagtacggaaacgtgagcgtgttcgaaaccaccggcggcttagtggtgttctggcagggaatcaagcagaagtctctggtggagctggagagactggctaacagatcctctctaaacctgacacacaacagaaccaagcggagcacagacggcaataatgccacacacctgagcaacatggaaagcgtccacaacctcgtctatgcccaactgcagttcacctacgacaccctccgaggctacatcaacagagccctggcccagatcgccgaggcttggtgtgtggatcagagacggaccctggaggtgttcaaggagttgagcaagatcaacccgtccgccatcttgagcgctatatacaacaagccaattgctgcgcggttcatgggcgacgtgctgggcctcgcctcatgtgtgaccattaatcaaacaagcgtcaaggtcctgagggatatgaacgttaaggagagcccaggcaggtgctatagcagacctgtggtgattttcaacttcgccaacagcagctacgtgcagtacggccagctgggcgaggacaacgagatcctgctgggcaaccaccgcactgaggagtgccagctgccaagtctgaagatattcatcgcgggaaattcagcttacgagtatgtagactacctgttcaagagaatgatagatcttagcagcatctccactgtggacagtatgatagctcttgatattgacccactggagaataccgacttcagagtgttggagctgtacagtcagaaggagctcaggagctccaatgtgttcgacctggaggagatcatgagggaattcaatagctacaagcagcaccaccaccatcatcac

SEQ ID NO: 193 - DNA, 2094 bp, Artificial Sequence
  Synthetic polypeptide
atggaatcccgaatctggtgcctcgttgtgtgcgtgaatttgtgcatcgtgtgtttgggcgccgccgtctcttcttcctccacacgtggtaccagcgcaacacactcccaccactcaagccacaccacgtccgcggcacacagcagaagcggcagtgtgagccaaagggtgaccagcagccagaccgtgagtcacggcgtgaacgagacaatctacaataccacactcaagtacggcgatgtggtgggcgtcaacaccaccaagtatccttacagagtctgttccatggcccagggcactgacctgatccggttcgaaagaaacatagtgtgcacctccatgaagcctatcaatgaggacctcgatgaaggcattatggtggtgtacaagaggaatattgtggcccataccttcaaggtgagagtgtaccagaaggtgctgaccttcagacggagctacgcctacatccatacaacctacctgctgggaagcaacaccgagtacgtggctcctccaatgtgggagatccaccacatcaatagccacagccagtgctactccagctacagcagagtgattgctggcaccgtcttcgtggcttaccacagagacagctatgagaacaagacaatgcagctcatgccagacgactactctaacacacattcaacccggtatgtgaccgtgaaggaccagtggcactcaagaggcagcacatggctctaccgagagacatgtaacctgaactgcatggttacaatcaccactgcaaggtctaagtacccatatcacttcttcgccacctctaccggagacgtggtggacatcagcccattctacaatggcaccaatcggaacgcaagctacttcggagagaacgccgacaagttcttcatcttcccgaactacaccatcgtgtccgatttcggcaggccaaacagcgccctggagacacaccggctggtggccttcctggagcgcgctgactccgttatctcttgggacatccaggatgagaagaatgtgacctgccaactgacattctgggaggcatccgagcggactatcagaagcgaggccgaggacagctaccacttcagcagcgctaagatgactgctaccttcctgtccaagaagcaggaggtgaacatgtctgattccgctctggactgcgtgagggacgaggctatcaacaagctccagcagatattcaatacttcctacaaccagacctacgagaagtacggtaacgtcagcgttttcgaaaccaccggcggcctggtcgtgttctggcagggaatcaagcagaagtcccttgtcgagctcgagagactggccaaccggtctagcctcaatctgacacacaataggaccaagagatctactgacggcaataacgccacacacctctccaacatggagagtgttcataacctggtttacgcccagctgcagttcacttacgataccctccgcggctacatcaacagggccctggcgcagatcgccgaggcctggtgcgtggatcaaagaaggaccctggaggtcttcaaggaactcagcaagatcaacccatctgctatcctgagcgccatctacaacaagccaatcgccgcccggttcatgggcgacgtcctgggcttggctagctgcgtgaccatcaatcagaccagcgtcaaggtgcttcgcgacatgaacgtcaaggagtcacctggccgctgttactcaaggccagtcgtgatcttcaatttcgccaatagctcctacgtgcagtacggacagttgggcgaggacaatgaaatactcctgggcaaccaccgcaccgaggagtgtcagctgccaagcctgaagatcttcatcgcgggaaactccgcttacgagtatgtggactacctgttcaagagaatgattgatctgagcagcatctccaccgtggacagcatgattgctctggatattgatcctctggagaacaccgatttccgcgtgctggagctgtacagccagaaggaattaaggagcagtaatgtgttcgacctggaggagatcatgagggagttcaacagttacaagcagcaccaccatcaccaccac

SEQ ID NO: 194 - DNA, 2094 bp, Artificial Sequence
  Synthetic polypeptide
atggagtccagaatctggtgcttggtggtgtgcgtgaatctttgcattgtgtgcctcggcgccgccgtgagcagcagcagtactagaggtacctccgctacccacagccaccactcttcccatacaaccagcgccgcccactcacgtagcggctctgtgagccagagggtgacaagctcacagaccgtgagccacggcgtgaacgagactatctacaacactaccctgaagtacggcgatgtggtgggagtgaataccacaaagtacccgtacagggtgtgttccatggcccagggcaccgacctgattcgcttcgaaagaaacatcgtctgcaccagcatgaagcctatcaacgaggatttggatgagggtattatggtggtctacaagagaaatattgtggcccacaccttcaaggtcagagtgtaccagaaggtcctgacgttcaggagatcttacgcttacatccacaccacctaccttctgggctccaacaccgagtatgtggccccgcctatgtgggagatccaccacattaattcccactctcaatgctacagctcctattccagagtgatcgccggcacagtcttcgtggcctaccaccgggacagctatgagaacaagactatgcagctcatgccagacgactatagcaatactcatagcactagatatgtgactgtgaaggaccagtggcatagcagaggcagcacttggctgtaccgggaaacatgcaatcttaattgcatggtcaccataaccaccgcgagatccaagtacccttaccacttcttcgccacctccactggtgacgtcgtggacatctcccctttctataacggaacaaatagaaacgccagctacttcggtgagaacgccgacaagttcttcatcttccctaactacaccatagtgagcgatttcggcagaccgaactccgctctggagacacaccggctggtggccttcctggaacgggccgatagtgttatctcttgggatattcaagacgagaagaacgtcacctgtcagctgactttctgggaagccagcgagaggaccatcagaagtgaagctgaggatagctaccatttctctagtgccaagatgactgccaccttcctgtccaagaagcaggaggtcaacatgtccgacagcgccctcgactgtgtgagagacgaggctattaacaagctgcagcagattttcaacactagctacaatcagacatacgagaagtatggaaacgtgagcgtgttcgaaactaccggtggcctggtggtattctggcagggcatcaagcagaagtccctggtggaattggagagactggctaacaggtcgtccctgaacctgactcacaatagaacgaagaggagcacagacggcaataatgccacccatctgtccaatatggagagtgtgcacaatttggtgtatgcccagctgcagttcacctacgacaccctcaggggctacatcaacagagccctcgcccagatcgctgaagcctggtgcgtggatcagaggaggaccctggaggtcttcaaggaactgagcaagataaacccatccgccatcctcagtgccatttataacaagcctattgccgccaggttcatgggcgacgtgctgggcctggcttcctgtgtcacgattaatcagacctccgtgaaggtgctgagggacatgaacgtgaaggaaagccctggacggtgttacagccgaccagtagtgatcttcaacttcgccaactcctcatacgtgcagtatggccagctgggcgaggacaatgaaattctgctgggcaaccacaggaccgaagagtgccagctgcctagcctgaagatattcatcgccggtaatagcgcctacgagtacgtcgactatcttttcaagagaatgatcgatctgtctagcatttctaccgtggattccatgatcgctcttgacattgacccactggagaacacagacttcagggtgctcgagctgtattcccagaaggaactcaggtctagcaacgttttcgacctcgaggaaattatgagagagttcaactcgtacaagcaacaccatcaccaccatcac

SEQ ID NO: 195 - DNA, 2094 bp, Artificial Sequence
  Synthetic polypeptide
atggagagccggatctggtgcctcgtggtgtgcgtgaacttatgcatcgtgtgcctcggcgccgccgtgagctctagctctacccggggcaccagcgccacccacagccaccacagcagccacaccacctcggccgctcacagccggagcggcagcgtgagccagcgggtgacctccagccagaccgtgtcccacggcgtgaacgagacgatctacaacaccaccctgaagtacggcgacgtggtgggagtgaacacgaccaagtacccctaccgggtgtgcagcatggcccagggcaccgacctgatccggttcgagcggaacattgtgtgcaccagcatgaagcccatcaacgaggacctggacgagggcatcatggtagtgtacaagagaaacatcgtggcccacaccttcaaggtgcgggtgtaccagaaggtgctgaccttccggcggagctacgcctacattcacacaacatacctgctgggcagcaacaccgagtacgtggctcctcccatgtgggagatccaccacatcaactctcatagccagtgctacagcagctacagccgggtgatcgccggcaccgtgttcgtggcctaccaccgggacagctacgagaacaagaccatgcagctgatgcccgacgactatagcaacacacactccactcggtacgtgaccgtgaaggaccagtggcacagcagaggcagcacctggctgtaccgggagacttgcaacctgaactgcatggtgaccatcaccaccgcccggtctaagtacccttaccacttcttcgccaccagcaccggcgatgtggtggacatcagccccttctacaacggcaccaaccggaacgccagctacttcggcgagaacgccgacaagttcttcatcttccccaactacaccatcgtgagcgacttcggccggcccaacagcgccctggaaactcaccggctggtggccttcctggagcgggccgacagcgtgatcagctgggacatccaggacgagaagaacgtgacctgccagctgacattctgggaggccagcgagcggaccatccggagcgaggccgaggatagctatcacttcagcagcgccaagatgaccgccaccttcctgagcaagaagcaggaggtgaacatgagcgattctgcactggactgcgtgcgggacgaggccatcaacaagctgcagcagatcttcaacaccagctacaaccagacctacgagaagtacggaaacgtgagcgtgttcgagactaccggcggccttgtcgtgttctggcagggaatcaagcagaagtccctggtcgagctcgagcgactggccaacagaagcagcctgaacctgacccacaaccggaccaagcggagcaccgacggcaacaacgccacacacctgtctaacatggagtctgtgcacaacctggtgtacgcccagctgcagttcacctacgacaccctgcggggctacatcaaccgggccctggcccagatcgccgaggcatggtgcgtggaccagcggcggaccctggaggtgttcaaggagctctctaagatcaacccgtctgccatcctgagcgccatttacaacaagcctatcgccgcaagattcatgggcgacgtcctgggcctggccagctgcgtgacgatcaatcagaccagcgtgaaggtcctgcgggacatgaacgtcaaggagagccccggcaggtgctatagccggcccgtggtgattttcaacttcgccaatagctcttacgtgcagtacggtcagttaggcgaggacaacgagatcttactgggcaaccaccggaccgaggagtgccaactcccgagcctcaagattttcattgccggcaatagcgcatacgaatatgtggactacctgttcaagcggatgatcgacctgagcagcatcagcaccgtggacagcatgattgctctggacatcgaccctctggagaacaccgacttccgggtgctggagctgtacagccagaaggagctgcggagctctaatgtgttcgacctggaggagatcatgcgggagttcaactcatataagcagcaccaccaccatcatcac

SEQ ID NO: 196 - DNA, 2094 bp, Artificial Sequence
  Synthetic polypeptide
atggagagccggatctggtgcctcgtggtgtgcgtgaacctttgcatcgtgtgcttgggcgccgccgtgagcagcagctccacccggggcacctccgccacccactcccaccactcctcccacaccacctcagccgcccactctcgctccggctccgtctcccagcgcgtcacctccagccagaccgttagccacggcgtcaacgaaaccatctacaacaccaccctcaagtacggcgacgtcgtcggcgtaaacacaaccaagtacccctaccgcgtctgctccatggcccagggcaccgacctcatccgcttcgagcgcaacatcgtctgcacctccatgaagcccatcaacgaggacctcgacgagggcatcatggtcgtctacaagcgcaatattgtggcccacaccttcaaggtccgcgtctaccagaaggtcctcaccttccgccgctcctacgcctacatccacacaacctacctcctcggctccaacaccgagtacgtcgcccctcccatgtgggagatccaccacatcaacagccacagccagtgctactcctcctactcccgcgtcatcgccggcaccgtcttcgtcgcctaccaccgcgactcctacgagaacaagaccatgcagctcatgcccgacgactacagcaatacccacagcacccgctacgtcaccgtcaaggaccagtggcacagcagaggctccacctggctctaccgcgagacatgcaacctcaactgcatggtcaccatcaccaccgcccgctccaagtatccttaccacttcttcgccacctccaccggcgatgtcgtggacatctcaccattctacaacggcaccaaccgcaacgccagttacttcggcgagaacgccgacaagttcttcatcttccccaactacaccatcgtctccgacttcggccgccccaactccgccctcgagacacacagactggtggccttcctcgagcgcgccgactccgtcatctcctgggacatccaggacgagaagaacgtcacctgccagctcacattctgggaggcctccgagcgcaccatccgctccgaggccgaggactcataccatttctccagcgccaagatgaccgccaccttcctctccaagaagcaggaggtcaacatgagcgacagcgctctcgactgcgtccgcgacgaggccatcaacaagctccagcagatcttcaacacctcctacaaccagacgtacgagaagtatggaaacgtcagtgtcttcgaaaccacgggcggcctggttgtattctggcagggaataaagcagaagtccctcgtcgagcttgagcgcctcgccaaccgctcctccctcaacctcacccacaaccgcaccaagcgctccaccgacggcaacaacgctacccacctgtccaacatggagtccgtccacaacctcgtctacgcccagctccagttcacctacgacaccctccgcggctacatcaaccgcgccctcgcccagatcgccgaggcctggtgcgtcgaccagcgccgcaccctcgaggtcttcaaggagctgagtaagatcaaccctagcgcgatcctcagcgctatctataacaagccaatcgctgctaggttcatgggagacgtgctcggcctcgcctcctgcgtgaccatcaatcagacatccgtgaaggtgctgcgcgacatgaatgtcaaggagagcccaggccgctgttattcccggcccgtcgtcattttcaatttcgccaatagctcttacgtccagtacggccagctcggcgaggacaacgagatcctgctgggcaaccaccgcaccgaggagtgccagctgcctagcctcaagattttcattgccggcaattccgcttacgaatacgtggactacctcttcaagcgcatgatcgacctctcctccatctccaccgtcgactccatgatcgccctggatatcgaccctctcgagaacaccgacttccgcgtgttggagctctactcccagaaggagctcagatccagcaacgtattcgacctcgaggagatcatgcgcgagttcaactcctataagcagcaccaccaccatcatcac

SEQ ID NO: 197 - DNA, 2094 bp, Artificial Sequence
  Synthetic polypeptide
atggagagccggatctggtgcttggtggtgtgcgtgaacttgtgcatcgtgtgcttgggcgccgccgtgagcagctctagcacccggggcaccagcgccacccacagccaccacagcagccacacgacctccgccgcccactcacggagcggcagcgtgagccagcgggtgaccagctcacagaccgtgtcccacggcgtgaacgagacgatctacaacaccaccctgaagtacggcgacgtggtgggcgtcaacactaccaagtacccctaccgggtgtgcagcatggcccagggcaccgacctgatccggttcgagcggaatattgtgtgtaccagcatgaagcccatcaacgaggacctggacgagggcatcatggtggtctacaagagaaacattgtggcccacaccttcaaggtgcgggtgtaccagaaggtgctgaccttccggcggagctacgcctacatccatacaacctacctgctgggcagcaacaccgagtacgtggcgcctcccatgtgggagatccaccacatcaactctcactcgcagtgctacagcagctacagccgggtgatcgccggcaccgtgttcgtggcctaccaccgggacagctacgagaacaagaccatgcagctgatgcccgacgactattctaacacccactccaccagatacgtgaccgtgaaggaccagtggcacagcaggggcagcacctggctgtaccgggagacttgcaacctgaactgcatggtgaccatcaccaccgcccggagtaagtatccatatcacttcttcgccaccagcacgggcgacgttgtggacatcagccccttctacaacggcaccaaccggaacgccagctacttcggcgagaacgccgacaagttcttcatcttccccaactacaccatcgtgagcgacttcggccggcccaacagcgccctggaaacccaccggctggtggccttcctggagcgggccgacagcgtgatcagctgggacatccaggacgagaagaacgtgacctgccagctgactttctgggaggccagcgagcggaccatccggagcgaggccgaagactcctaccacttcagcagcgccaagatgaccgccaccttcctgagcaagaagcaggaggtgaacatgagcgattcagctctggactgcgtgcgggacgaggccatcaacaagctgcagcagatcttcaacaccagctacaaccagacttacgagaagtatggaaacgtgagcgtgttcgagacaaccggcggcctcgtggtgttctggcagggtatcaagcagaagtctctcgtggagctggagagactggccaacagaagcagcctgaacctgacccacaaccggaccaagcggagcaccgacggcaacaacgctacccatctgtctaacatggagtcagtgcacaacctggtgtacgcccagctgcagttcacctacgacaccctgcggggctacatcaaccgggccctggcccagatcgccgaggcctggtgcgtggaccagcggcggaccctggaggtgttcaaggagctgtccaagatcaacccttccgccatcctgagcgccatttataataagccgatcgccgcccggttcatgggcgatgttctgggcctggccagctgcgtcaccattaatcagaccagcgttaaggtcctgcgggacatgaatgtcaaggagagccccggcaggtgctactcccgccccgtggtgatattcaacttcgccaactctagctacgtgcagtacggccaactaggcgaggacaacgagatcttgctcggtaaccaccggaccgaggagtgccagttaccttccctgaagattttcatcgcgggcaactccgcctacgagtatgtggactacctgttcaagcggatgatcgatctttctagcatcagcaccgtggacagcatgatagccctggacatcgacccactggagaacaccgacttccgggtgctggagctgtacagccagaaggagcttcggagcagcaatgtgttcgacctggaggagatcatgcgggagttcaattcttacaagcagcaccaccaccatcatcac

SEQ ID NO: 198 - DNA, 2094 bp, Artificial Sequence
  Synthetic polypeptide
atggagagccggatctggtgcctcgtggtgtgcgtgaacctctgcatcgtgtgcctcggcgccgccgtgtcttcatcctccacccggggcacctccgccacccactcccaccactcctcccacaccactagtgccgcccactcacgctccggctccgtctcccagcgcgtcacctcatcccagacagtgagccacggcgtcaacgaaaccatctacaacaccaccctcaagtacggcgacgtcgtgggcgtgaacactacaaagtacccctaccgcgtctgctccatggcccagggcaccgacctgatccgcttcgagcgcaacatcgtctgcacctccatgaagcccatcaacgaggacctcgacgagggcatcatggtcgtctacaagaggaacattgtggcccacaccttcaaggtccgcgtctaccagaaggtcctcaccttccgccgctcctacgcctacatccacactacgtacctcctcggctccaacaccgagtacgtcgcccctcccatgtgggagatccaccacatcaactcgcacagccagtgctactcctcctactcccgcgtcatcgccggcaccgtcttcgtcgcctaccaccgcgactcctacgagaacaagaccatgcagctcatgcccgacgactatagcaacacacatagcacccgctacgtcaccgtcaaggaccagtggcatagcagaggctccacctggctctaccgcgagacgtgcaacctcaactgcatggtcaccatcaccaccgcccgcagcaagtatccatatcacttcttcgccacctccacaggagacgtggtcgacatctcgcctttctacaacggcaccaaccgcaacgctagctacttcggcgagaacgccgacaagttcttcatcttccccaactacaccatcgtctccgacttcggccgccccaactccgccctcgagactcaccgcttggtggccttcctcgagcgcgccgactccgtcatctcctgggacatccaggacgagaagaacgtcacctgccagctgaccttctgggaggcctccgagcgcaccatccgctccgaggccgaggacagctaccacttcagcagcgccaagatgaccgccaccttcctctccaagaagcaggaggtcaacatgagcgacagcgcccttgactgcgtccgcgacgaggccatcaacaagctccagcagatcttcaacacctcctacaaccagacttatgagaagtacggaaacgtctccgttttcgagacaacaggaggcctggttgtcttctggcagggcattaagcagaagtccctcgtcgagctggagagactcgccaaccgctcctccctcaacctcacccacaaccgcaccaagcgctccaccgacggcaacaatgctacacacctgagcaacatggagtccgtccacaacctcgtctacgcccagctccagttcacctacgacaccctccgcggctacatcaaccgcgccctcgcccagatcgccgaggcgtggtgcgtcgaccagcgccgcaccctcgaggtcttcaaggagctgtccaagatcaaccctagcgccatcctgtccgcaatctataacaagcctatcgcggctaggttcatgggcgatgtgctcggcctcgcctcctgcgtgactattaatcagaccagcgtcaaggtgctgcgcgacatgaacgtgaaggagagccctggccgctgctattccaggcccgtcgtcatcttcaatttcgccaattccagctatgtccagtacggccagctcggcgaggacaacgagatcctgcttggcaaccaccgcaccgaggagtgtcagctccctagcctgaagattttcattgccggcaatagcgcttatgagtatgtggactacctcttcaagcgcatgatcgacctctcctccatctccaccgtcgactccatgatcgccctggacatcgacccactggagaacaccgacttccgcgtgctcgaactctactcccagaaggaactgagatcaagcaacgtgttcgacctcgaggagatcatgcgcgagttcaactcttataagcagcaccaccaccatcatcac

SEQ ID NO: 199 - DNA, 642 bp, Artificial Sequence
  Synthetic polypeptide
atgctcagacttctcctcagacaccacttccactgcctcttgctttgtgccgtctgggccacaccttgcctcgccagcccttggagcaccttgacagccaaccagaacccttcccctccttggtcaaagttgacctacagcaagcctcacgacgctgctaccttctactgtccattcctgtaccctagccctccaagatctccgctgcagttcagcggcttccagagggtgtctaccggacctgagtgcaggaatgagacgctgtacctgctgtacaacagagagggccagaccctggtggaaagaagctccacctgggtcaagaaggtaatctggtacctgagcggcagaaaccagacaatactccagagaatgccacggaccgctagcaagcctagcgatggaaacgtgcagattagcgtggaggacgcaaagattttcggcgcccacatggtgccaaagcagacaaagctgctgcggttcgtggtcaacgacggcacccggtaccagatgtgcgtgatgaagctggagagctgggctcacgtgttcagagattactctgtgagcttccaagtgcggctcaccttcaccgaagccaacaatcagacctacactttctgtactcaccctaacctgatcgtg

SEQ ID NO: 200 - DNA, 642 bp, Artificial Sequence
  Synthetic polypeptide
atgcttagactcctcctcagacaccacttccattgtctccttttgtgcgccgtgtgggccaccccttgccttgcatcaccttggtctaccctcaccgccaaccagaaccctagccctccttggagtaagttaacatactctaagccgcacgacgccgccaccttctactgtcctttcctctacccaagcccacctcgtagcccacttcagttctctggattccagagagtttcaacaggccctgagtgtcggaacgagactctgtacctgttgtataacagagagggacagaccctggtggagcggtcctccacctgggtgaagaaggtgatctggtatctgagcggcagaaaccagaccatcctgcagcggatgccaaggaccgctagcaagccaagcgacggcaatgtgcagattagcgtggaggatgctaagattttcggcgcacacatggttcctaagcagaccaagctgttacggttcgtggtgaacgatggaactcggtaccaaatgtgcgtgatgaagctggagtcatgggcacatgtgttccgtgactactctgtttctttccaggtgcgcctgaccttcaccgaggccaataaccagacatacaccttctgtacgcacccaaatctgatcgta

SEQ ID NO: 201 - DNA, 642 bp, Artificial Sequence
  Synthetic polypeptide
atgctcagacttttgctcagacaccacttccactgtttgttgttatgtgccgtgtgggctaccccttgcctcgcatctccgtggtccacactcacagccaaccagaatccttctcctccttggagcaagctcacatatagcaagcctcacgacgcggcaaccttctactgcccattcctgtatccttctcctccgcggagccctctgcagttctccggattccagagagtgtccaccggtcctgagtgcagaaatgaaacactgtatcttctctacaacagagagggccagacccttgtggagagaagcagcacctgggtgaagaaggtcatttggtatctgtctggcagaaaccagaccatactgcagcggatgccaagaacagcctccaagccatccgacggtaacgtgcagatctccgtggaggacgccaagattttcggcgcccacatggtgccaaagcagaccaagctgctgagattcgtggtgaacgatggcaccaggtaccagatgtgcgttatgaagcttgagtcctgggctcacgtgttcagagactactctgtgagcttccaggtgagactgacattcacagaggccaacaaccagacttacaccttctgcacgcatcctaatctgatcgtg

SEQ ID NO: 202 - DNA, 642 bp, Artificial Sequence
  Synthetic polypeptide
atgctcagacttcttctcagacaccacttccactgtttgcttctctgcgcagtgtgggcaaccccttgccttgcttccccttggtcgactctcaccgccaaccagaatccaagccctccttggagcaagctcacttacagcaagccgcacgacgccgccaccttctactgtcctttcctgtaccctagccctccaagatctcctctgcaattctctggattccagagagtgagcaccggcccagagtgccggaacgagactctgtatctgctgtacaatagggagggacaaaccctggtggagaggagcagcacatgggtgaagaaggtgatctggtacctgagcggcagaaaccagaccatcctgcagagaatgccacggaccgccagcaagccaagcgatggcaacgtccagattagcgtggaagacgccaagatcttcggagcccacatggtgcctaagcagaccaagcttctgcgattcgtggtgaacgacggtacccgctaccaaatgtgcgtgatgaagctggagtcatgggcccacgtcttccgcgactacagcgtatccttccaggtgaggcttaccttcaccgaggccaacaaccaaacctacacattctgcacccatccaaatttgattgtg

SEQ ID NO: 203 - DNA, 642 bp, Artificial Sequence
  Synthetic polypeptide
atgctcagactattgttgagacatcacttccattgcctccttttgtgcgccgtgtgggctaccccttgcctcgcctcaccttggagcaccttgaccgccaaccagaacccgagccctccgtggtcaaagctcacctacagcaagcctcacgacgccgcaaccttctattgtccattcctgtacccttctccgccgaggtcccctcttcagttcagcggattccagagagtgtctaccggaccagaatgcagaaacgaaacactgtatctgctgtacaaccgggagggccagaccctggtcgagcggagctctacctgggtcaagaaggttatatggtatctgagcggcaggaaccagaccatcctgcagcgcatgcctagaaccgctagcaagccaagcgacggcaacgttcagatctccgtggaggacgctaagatcttcggcgcccatatggtgccaaagcagactaagctgctgagattcgtggtaaacgacggcacaagatatcagatgtgcgtgatgaagctggagagctgggctcatgtgttcagggactactccgtgagtttccaggtgaggctgacattcaccgaggctaataatcagacctacaccttctgcactcacccaaatctgatcgtg

SEQ ID NO: 204 - DNA, 642 bp, Artificial Sequence
  Synthetic polypeptide
atgctcagattattgctcagacaccacttccactgcctcctcttgtgcgccgtgtgggcgacaccgtgtctcgcaagcccttggtccacactaacggccaaccagaaccctagccctccttggagcaagctcacttatagcaagccacacgatgcggccactttctactgtcctttcctgtatccatcccctcctagatctcctctgcagttcagcggattccagagagtatctactggccctgagtgcagaaatgaaaccctctatctcctgtacaatcgggagggccagactttggtggagcgcagctccacctgggtgaagaaggtgatctggtacctgagcggcagaaaccagaccatcctacagaggatgccaaggaccgccagcaagccatctgacggcaacgtgcagatctctgtggaggacgccaagatcttcggagcccatatggtgcctaagcagacaaagctgttgaggttcgtcgtgaatgacggcacaagataccagatgtgtgtgatgaagctggagagctgggctcacgtgttccgagactacagcgtctcgttccaggtgagactgacattcaccgaggcaaacaaccagacctacaccttctgtacgcaccctaacctgatcgtt

SEQ ID NO: 205 - DNA, 642 bp, Artificial Sequence
  Synthetic polypeptide
atgcttcggctcctccttcggcaccacttccactgcctcctcctctgcgccgtgtgggccacaccttgcctcgccagcccctggagcaccctcaccgccaaccagaaccccagccctccgtggtctaagttaacctacagcaagccccacgacgccgccaccttctactgccccttcctgtacccttcaccgccgcggagcccgctgcagttcagcggcttccagcgggtgagcaccggccccgagtgccggaacgagacgctgtacctgctgtacaaccgggagggccagaccctggtggagcggagcagcacctgggtgaagaaggtgatctggtacctgagcggccggaaccagaccatcctgcagcggatgccccggaccgcctcaaagccaagcgacggcaacgtgcagatcagcgtggaggacgccaagatcttcggcgcccacatggtgcccaagcagaccaagttgctgcgcttcgtggtgaacgacggcacccggtaccagatgtgcgtgatgaagctggagagctgggcccacgtgttccgggactacagcgtgagcttccaggtgcggctgacattcaccgaggccaacaatcagacctacaccttctgcacccaccccaacctgatcgtg

SEQ ID NO: 206 - DNA, 642 bp, Artificial Sequence
  Synthetic polypeptide
atgttacggctccttctccgccaccacttccactgcctcttactctgcgccgtgtgggccactccatgccttgccagcccctggagcaccttgaccgccaaccagaaccccagcccaccttggagtaagctcacctacagcaagccccacgacgccgccaccttctactgccccttcctgtatccgagcccaccgcggagcccgctgcagttcagcggcttccagcgggtgagcaccggccccgagtgccggaacgaaaccctgtacctgctgtacaaccgggagggccagaccctggtggagcggagcagcacctgggtgaagaaggtgatctggtacctgagcggccggaaccagaccatcctgcagcggatgccccggaccgctagtaagcctagcgacggcaacgtgcagatcagcgtggaggacgccaagatcttcggcgcccacatggtgcccaagcagaccaagctgcttaggttcgtggtgaacgacggcacccggtaccagatgtgcgtgatgaagctggagagctgggcccacgtgttccgggactacagcgtgagcttccaggtgcggctgaccttcaccgaggccaacaaccagacatacaccttctgcacccaccccaacctgatcgtg

SEQ ID NO: 207 - DNA, 642 bp, Artificial Sequence
  Synthetic polypeptide
atgctacggctcctactccgccaccacttccactgcttacttttgtgcgccgtgtgggccacaccatgcttggccagcccctggagcaccctcaccgccaaccagaacccctcacctccctggtccaagctcacctactccaagccccacgacgccgccaccttctactgccccttcctctatccatctcctccacgcagcccactccagttctccggcttccagcgcgtctccaccggccccgagtgccgcaacgagacgctctacctcctctacaaccgcgagggccagaccctcgtcgagaggtcatccacctgggtcaagaaggtcatctggtacctctccggccgcaaccagaccatcctccagcgcatgccccgcaccgcgtctaagccgtccgacggcaacgtccagatctccgtcgaggacgccaagatcttcggcgcccacatggtccccaagcagaccaagctcctccgcttcgtcgtcaacgacggcacccgctaccagatgtgcgtcatgaagctcgagtcctgggcccacgtcttccgcgactactccgtctccttccaggtccgcctcaccttcaccgaggccaataaccagacttacaccttctgcacccaccccaacctcatcgtc

SEQ ID NO: 208 - DNA, 642 bp, Artificial Sequence; identical to SEQ ID NO: 207
  Synthetic polypeptide

SEQ ID NO: 209 - DNA, 642 bp, Artificial Sequence
  Synthetic polypeptide
atgcttcggctcctcctaaggcaccacttccactgccttttgctttgcgccgtgtgggccaccccttgcttggccagcccctggagcaccctcaccgccaaccagaacccctcccctccctggtccaagctcacctactccaagccccacgacgccgccaccttctactgccccttcctctacccgtcccctccacgcagcccactccagttctccggcttccagcgcgtctccaccggccccgagtgccgcaacgaaacactctacctcctctacaaccgcgagggccagaccctcgtcgagcgctcctccacctgggtcaagaaggtcatctggtacctctccggccgcaaccagaccatcctccagcgcatgccccgcaccgcaagcaagccatccgacggcaacgtccagatctccgtcgaggacgccaagatcttcggcgcccacatggtccccaagcagaccaagctcctccgcttcgtcgtcaacgacggcacccgctaccagatgtgcgtcatgaagctcgagtcctgggcccacgtcttccgcgactactccgtctccttccaggtccgcctcaccttcaccgaggccaataatcagacatacaccttctgcacccaccccaacctcatcgtc

SEQ ID NO: 210 - DNA, 387 bp, Artificial Sequence
  Synthetic polypeptide
atgcggctgtgtcgggtgtggctgtctgtttgtctgtgcgccgtggtgctgggtcagtgccagcgggaaaccgcggaaaagaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaac

SEQ ID NO: 211 - protein, 742 aa, Artificial Sequence
  Synthetic polypeptide
MRPGLPSYLIILAVCLFSHLLSSRYGAEAVSEPLDKAFHLLLNTYGRPIRFLRENTTQCTYNSSLRNSTVVRENAISFNFFQSYNQYYVFHMPRCLFAGPLAEQFLNQVDLTETLERYQQRLNTYALVSKDLASYRSFSQQLKAQDSLGEQPTTVPPPIDLSIPHVWMPPQTTPHGWTESHTTSGLHRPHFNQTCILFDGHDLLFSTVTPCLHQGFYLIDELRYVKITLTEDFFVVTVSIDDDTPMLLIFGHLPRVLFKAPYQRDNFILRQTEKHELLVLVKKDQLNRHSYLKDPDFLDAALDFNYLDLSALLRNSFHRYAVDVLKSGRCQMLDRRTVEMAFAYALALFAAARQEEAGAQVSVPRALDRQAALLQIQEFMITCLSQTPPRTTLLLYPTAVDLAKRALWTPNQITDITSLVRLVYILSKQNQQHLIPQWALRQIADFALKLHKTHLASFLSAFARQELYLMGSLVHSMLVHTTERREIFIVETGLCSLAELSHFTQLLAHPHHEYLSDLYTPCSSSGRRDHSLERLTRLFPDATVPATVPAALSILSTMQPSTLETFPDLFCLPLGESFSALTVSEHVSYIVTNQYLIKGISYPVSTTVVGQSLIITQTDSQTKCELTRNMHTTHSITVALNISLENCAFCQSALLEYDDTQGVINIMYMHDSDDVLFALDPYNEVVVSSPRTHYLMLLKNGTVLEVTDVVVDATDSRLLMMSVYALSAIIGIYLLYRMLKTC

SEQ ID NO: 212 - protein, 278 aa, Artificial Sequence
  Synthetic polypeptide
MCRRPDCGFSFSPGPVILLWCCLLLPIVSSAAVSVAPTAAEKVPAECPELTRRCLLGEVFEGDKYESWLRPLVNVTGRDGPLSQLIRYRPVTPEAANSVLLDEAFLDTLALLYNNPDQLRALLTLLSSDTAPRWMTVMRGYSECGDGSPAVYTCVDDLCRGYDLTRLSYGRSIFTEHVLGFELVPPSLFNVVVAIRNEATRTNRAVRLPVSTAAAPEGITLFYGLYNAVKEFCLRHQLDPPLLRHLDKYYAGLPPELKQTRVNLPAHSRYGPQAVDAR

SEQ ID NO: 213 - protein, 171 aa, Artificial Sequence
  Synthetic polypeptide
MSPKDLTPFLTALWLLLGHSRVPRVRAEECCEFINVNHPPERCYDFKMCNRFTVALRCPDGEVCYSPEKTAEIRGIVTTMTHSLTRQVVHNKLTSCNYNPLYLEADGRIRCGKVNDKAQYLLGAAGSVPYRWINLEYDKITRIVGLDQYLESVKKHKRLDVCRAKMGYMLQ

SEQ ID NO: 214 - protein, 214 aa, Artificial Sequence
  Synthetic polypeptide
MLRLLLRHHFHCLLLCAVWATPCLASPWSTLTANQNPSPPWSKLTYSKPHDAATFYCPFLYPSPPRSPLQFSGFQRVSTGPECRNETLYLLYNREGQTLVERSSTWVKKVIWYLSGRNQTILQRMPRTASKPSDGNVQISVEDAKIFGAHMVPKQTKLLRFVVNDGTRYQMCVMKLESWAHVFRDYSVSFQVRLTFTEANNQTYTFCTHPNLIV

SEQ ID NO: 215 - protein, 129 aa, Artificial Sequence
  Synthetic polypeptide
MRLCRVWLSVCLCAVVLGQCQRETAEKNDYYRVPHYWDACSRALPDQTRYKYVEQLVDLTLNYHYDASHGLDNFDVLKRINVTEVSLLISDFRRQNRRGGTNKRTTFNAAGSLAPHARSLEFSVRLFAN

SEQ ID NO: 216 - protein, 907 aa, Artificial Sequence; identical to SEQ ID NO: 46
  Synthetic polypeptide

SEQ ID NO: 217 - protein, 557 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRG

SEQ ID NO: 218 - protein, 900 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGRKRKSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRGESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMK

SEQ ID NO: 219 - protein, 1047 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRGESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGASSSDSLVSPPESPVPATIPLSSVIVAENSDQEESEQSDEEQEEGAQEEREDTVSVKSEPVSEIEEVASEEEEDGAEEPTASGGKSTHPMVTRSKADQ

SEQ ID NO: 220 - protein, 491 aa, Artificial Sequence
  Synthetic polypeptide
MESSAKRKMDPDNPDEGPSSKVPRPETPVTKATTFLQTMLRKEVNSQLSLGDPLFPELAEESLKTFEQVTEDCNENPEKDVLTELVKQIKVRVDMVRHRIKEHMLKKYTQTEEKFTGAFNMMGGCLQNALDILDKVHEPFEDMKCIGLTMQSMYENYIVPEDKREMWMACIKELHDVSKGAANKLGGALQAKARAKKDELRRKMMYMCYRNIEFFTKNSAFPKTTNGCSQAMAALQNLPQCSPDEIMSYAQKIFKILDEERDKVLTHIDHIFMDILTTCVETMCNEYKVTSDACMMTMYGGISLLSEFCRVLCCYVLEETSVMLAKRPLITKPEVISVMKRRIEEICMKVFAQYILGADPLRVCSPSVDDLRAIAEESDEEEAIVAYTLATAGASSSDSLVSPPESPVPATIPLSSVIVAENSDQEESEQSDEEQEEGAQEEREDTVSVKSEPVSEIEEVASEEEEDGAEEPTASGGKSTHPMVTRSKADQ

SEQ ID NO: 221 - protein, 580 aa, Artificial Sequence
  Synthetic polypeptide
MESSAKRKMDPDNPDEGPSSKVPRPETPVTKATTFLQTMLRKEVNSQLSLGDPLFPELAEESLKTFEQVTEDCNENPEKDVLTELGDILAQAVNHAGIDSSSTGPTLTTHSCSVSSAPLNKPTPTSVAVTNTPLPGASATPELSPRKKPRKTTRPFKVIIKPPVPPAPIMLPLIKQEDIKPEPDFTIQYRNKIIDTAGCIVISDSEEEQGEEVETRGATASSPSTGSGTPRVTSPTHPLSQMNHPPLPDPLGRPDEDSSSSSSSSCSSASDSESESEEMKCSSGGGASVTSSHHGRGGFGGAASSSLLSCGHQSSGGASTGPRKKKSKRISELDNEKVRNIMKDKNTPFCTPNVQTRRGRVKIDEVSRMFRHTNRSLEYKNLPFMIPSMHQVLEEAIKVCKTMQVNNKGIQIIYTRNHEVKNEVDQVRCRLGSMCNLALSTPFLMEHTMPVTHPPDVAQRTADACNDGVKAVWNLKELHTHQLCPRSSDYRNMIIHAATPVDLLGALNLCLPLMQKFPKQVMVRIFSTNQGGFMLPIYETAAKAYAVGQFEKPTETPPEDLDTLSLAIEAAIQDLRNKSQ

SEQ ID NO: 222 - protein, 561 aa, Artificial Sequence
  Synthetic polypeptide
MESRGRRCPEMISVLGPISGHVLKAVFSRGDTPVLPHETRLLQTGIHVRVSQPSLILVSQYTPDSTPCHRGDNQLQVQHTYFTGSEVENVSVNVHNPTGRSICPSQEPMSIYVYALPLKMLNIPSINVHHYPSAAERKHRHLPVADAVIHASGKQMWQARLTVSGLAWTRQQNQWKEPDVYYTSAFVFPTKDVALRHVVCAHELVCSMENTRATKMQVIGDQYVKVYLESFCEDVPSGKLFMHVTLGSDVEEDLTMTRNPQPFMRPHERNGFTVLCPKNMIIKPGKISHIMLDVAFTSHEHFGLLCPKSIPGLSISGNLLMNGQQIFLEVQAIRETVELRQYDPVAALFFFDIDLLLQRGPQYSEHPTFTSQYRIQGKLEYRHTWDRHDEGAAQGDDDVWTSGSDSDEELVTTERKTPRVTGGGAMASASTSAGRKRKSASSATACTAGVMTRGRLKAESTVAPEEDTDEDSDNEIHNPAVFTWPPWQAGILARNLVPMVATVQGQNLKYQEFFWDANDIYRIFAELEGVWQPAAQPKRRRHRQDALPGPCIASTPKKHRG

SEQ ID NO: 223 - protein, 698 aa, Artificial Sequence
  Synthetic polypeptide
MESRIWCLVVCVNLCIVCLGAAVSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQHHHHHH

SEQ ID NO: 224 - protein, 742 aa, Artificial Sequence; identical to SEQ ID NO: 211
  Synthetic polypeptide

SEQ ID NO: 225 - DNA, 2464 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgcgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 226 - DNA, 1045 bp, Artificial Sequence; identical to SEQ ID NO: 142
  Synthetic polypeptide

SEQ ID NO: 227 - DNA, 1072 bp, Artificial Sequence
  Synthetic polypeptide
tcaagcttttggaccctcgtacagaagctaatacgactcactatagggaaataagagagaaaagaagagtaagaagaaatataagagccaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgcgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 228 - DNA, 2932 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtctgataataggctggagcctcggtggccatgcttcttgccccttgggcctccccccagcccctcctccccttcctgcacccgtacccccgtggtctttgaataaagtctgagtgggcggc

SEQ ID NO: 229 - DNA, 2956 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcgggtaaagtacgtggaggacaaggtagtcgacccgctaccgccctacctcaagggtctggacgacctcatgagcggcctgggcgccgcgggaaaggccgttggcgtagccattggggccgtgggtggcgcggtggcctccgtggtcgaaggcgttgccaccttcctcaaaaaccccttcggagcgttcaccatcatcctcgtggccatagctgtagtcattatcacttatttgatctatactcgacagcggcgtttgtgcacgcagccgctgcagaacctctttccctatctggtgtccgccgacgggaccaccgtgacgtcgggcagcaccaaagacacgtcgttacaggctccgccttcctacgaggaaagtgtttataattctggtcgcaaaggaccgggaccaccgtcgtctgatgcatccacggcggctccgccttacaccaacgagcaggcttaccagatgcttctggccctggcccgtctggacgcagagcagcgagcgcagcagaacggtacagattctttggacggacggactggcacgcaggacaagggacagaagcccaacctactagaccgactgcgacatcgcaaaaacggctaccgacacttgaaagactctgacgaagaagagaacgtcgattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 230 - DNA, 2356 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgactgataataggctggagcctcggtggccatgcttcttgccccttgggcctccccccagcccctcctccccttcctgcacccgtacccccgtggtctttgaataaagtctgagtgggcggc

SEQ ID NO: 231 - DNA, 2383 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 232 - DNA, 2377 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgaccaccatcaccaccatcactgatgataataggctggagcctcggtggccatgcttcttgccccttgggcctccccccagcccctcctccccttcctgcacccgtacccccgtggtctttgaataaagtctgagtgggcggc

SEQ ID NO: 233 - DNA, 2287 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagtgataataggctggagcctcggtggccatgcttcttgccccttgggcctccccccagcccctcctccccttcctgcacccgtacccccgtggtctttgaataaagtctgagtgggcggc

SEQ ID NO: 234 - DNA, 2311 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 235 - DNA, 2305 bp, Artificial Sequence
  Synthetic polypeptide
tcaagcttttggaccctcgtacagaagctaatacgactcactatagggaaataagagagaaaagaagagtaagaagaaatataagagccaccatggaatccaggatctggtgcctggtagtctgcgttaacttgtgtatcgtctgtctgggtgctgcggtttcctcatcttctactcgtggaacttctgctactcacagtcaccattcctctcatacgacgtctgctgctcactctcgatccggttcagtctctcaacgcgtaacttcttcccaaacggtcagccatggtgttaacgagaccatctacaacactaccctcaagtacggagatgtggtgggggtcaataccaccaagtacccctatcgcgtgtgttctatggcccagggtacggatcttattcgctttgaacgtaatatcgtctgcacctcgatgaagcccatcaatgaagacctggacgagggcatcatggtggtctacaaacgcaacatcgtcgcgcacacctttaaggtacgagtctaccagaaggttttgacgtttcgtcgtagctacgcttacatccacaccacttatctgctgggcagcaacacggaatacgtggcgcctcctatgtgggagattcatcatatcaacagccacagtcagtgctacagttcctacagccgcgttatagcaggcacggttttcgtggcttatcatagggacagctatgaaaacaaaaccatgcaattaatgcccgacgattattccaacacccacagtacccgttacgtgacggtcaaggatcaatggcacagccgcggcagcacctggctctatcgtgagacctgtaatctgaattgtatggtgaccatcactactgcgcgctccaaatatccttatcattttttcgccacttccacgggtgacgtggttgacatttctcctttctacaacggaaccaatcgcaatgccagctactttggagaaaacgccgacaagtttttcatttttccgaactacactatcgtctccgactttggaagaccgaattctgcgttagagacccacaggttggtggcttttcttgaacgtgcggactcggtgatctcctgggatatacaggacgaaaagaatgtcacttgtcaactcactttctgggaagcctcggaacgcaccattcgttccgaagccgaggactcgtatcacttttcttctgccaaaatgaccgccactttcttatctaagaagcaagaggtgaacatgtccgactctgcgctggactgcgtacgtgatgaggctataaataagttacagcagattttcaatacttcatacaatcaaacatatgaaaaatatggaaacgtgtccgtctttgaaaccactggtggtttggtagtgttctggcaaggtatcaagcaaaaatctctggtggaactcgaacgtttggccaaccgctccagtctgaatcttactcataatagaaccaaaagaagtacagatggcaacaatgcaactcatttatccaacatggaatcggtgcacaatctggtctacgcccagctgcagttcacctatgacacgttgcgcggttacatcaaccgggcgctggcgcaaatcgcagaagcctggtgtgtggatcaacggcgcaccctagaggtcttcaaggaactcagcaagatcaacccgtcagccattctctcggccatttacaacaaaccgattgccgcgcgtttcatgggtgatgtcttgggcctggccagctgcgtgaccatcaaccaaaccagcgtcaaggtgctgcgtgatatgaacgtgaaggagtcgccaggacgctgctactcacgacccgtggtcatctttaatttcgccaacagctcgtacgtgcagtacggtcaactgggcgaggacaacgaaatcctgttgggcaaccaccgcactgaggaatgtcagcttcccagcctcaagatcttcatcgccgggaactcggcctacgagtacgtggactacctcttcaaacgcatgattgacctcagcagtatctccaccgtcgacagcatgatcgccctggatatcgacccgctggaaaataccgacttcagggtactggaactttactcgcagaaagagctgcgttccagcaacgtttttgacctcgaagagatcatgcgcgaattcaactcgtacaagcagcaccatcaccaccatcactgataataggctggagcctcggtggccatgcttcttgccccttgggcctccccccagcccctcctccccttcctgcacccgtacccccgtggtctttgaataaagtctgagtgggcggc

SEQ ID NO: 236 - DNA, 724 bp, Artificial Sequence; identical to SEQ ID NO: 143
  Synthetic polypeptide

SEQ ID NO: 237 - DNA, 748 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 238 - DNA, 853 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 239 - DNA, 880 bp, Artificial Sequence
  Synthetic polypeptide
tcaagcttttggaccctcgtacagaagctaatacgactcactatagggaaataagagagaaaagaagagtaagaagaaatataagagccaccatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 240 - DNA, 598 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 241 - DNA, 625 bp, Artificial Sequence
  Synthetic polypeptide
tcaagcttttggaccctcgtacagaagctaatacgactcactatagggaaataagagagaaaagaagagtaagaagaaatataagagccaccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaacgattacaaggacgatgacgataagtgatgataataggctggagcctcggtggccatgcttcttgccccttgggcctccccccagcccctcctccccttcctgcacccgtacccccgtggtctttgaataaagtctgagtgggcggc

SEQ ID NO: 242 - DNA, 2434 bp, Artificial Sequence
  Synthetic polypeptide
tcaagcttttggaccctcgtacagaagctaatacgactcactatagggacagacgagagagaagcacgccaattctgcctgcttaagccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgctgataataggctggagcctcggtggccatgcttcttgccccttgggcctccccccagcccctcctccccttcctgcacccgtacccccgtggtctttgaataaagtctgagtgggcggc

SEQ ID NO: 243 - DNA, 1044 bp, Artificial Sequence
  Synthetic polypeptide
tcaagcttttggaccctcgtacagaagctaatacgactcactatagggcttaagcaggcagaattggcccttagcctgtaccagccgaaccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 244 - DNA, 1045 bp, Artificial Sequence
  Synthetic polypeptide
tcaagcttttggaccctcgtacagaagctaatacgactcactatagggtggctcttatatttcttcttactcttcttttctctcttatttccatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 245 - DNA, 722 bp, Artificial Sequence
  Synthetic polypeptide
tcaagcttttggaccctcgtacagaagctaatacgactcactatagggttcggctggtacaggctaaccagaagacagataagagcctccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagtgataataggctggagcctcggtggccatgcttcttgccccttgggcctccccccagcccctcctccccttcctgcacccgtacccccgtggtctttgaataaagtctgagtgggcggc

SEQ ID NO: 246 - DNA, 853 bp, Artificial Sequence
  Synthetic polypeptide
tcaagcttttggaccctcgtacagaagctaatacgactcactatagggtggctcttatatttcttcttagtccgaattcgaagtacggctacatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgtttgataataggctggagcctcggtggccatgcttcttgccccttgggcctccccccagcccctcctccccttcctgcacccgtacccccgtggtctttgaataaagtctgagtgggcggc

SEQ ID NO: 247 - DNA, 853 bp, Artificial Sequence; identical to SEQ ID NO: 246
  Synthetic polypeptide

SEQ ID NO: 248 - DNA, 597 bp, Artificial Sequence
  Synthetic polypeptide
tcaagcttttggaccctcgtacagaagctaatacgactcactatagggtagccgtacttcgaattcggacaagcttctctctcgtctgtccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 249 - DNA, 597 bp, Artificial Sequence
  Synthetic polypeptide
tcaagcttttggaccctcgtacagaagctaatacgactcactatagggtagccgtacttcgaattcggactttcttttctctcttatttccatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 250 - DNA, 3364 bp, Artificial Sequence; identical to SEQ ID NO: 148
  Synthetic polypeptide

SEQ ID NO: 251 - DNA, 3388 bp, Artificial Sequence
  Synthetic polypeptide
tcaagcttttggaccctcgtacagaagctaatacgactcactatagggaaataagagagaaaagaagagtaagaagaaatataagagccaccatggagtcgcgcggtcgccgttgtcccgaaatgatatccgtactgggtcccatttcggggcacgtgctgaaagccgtgtttagtcgcggcgatacgccggtgctgccgcacgagacgcgactcctgcagacgggtatccacgtacgcgtgagccagccctcgctgatcctggtgtcgcagtacacgcccgactcgacgccatgccaccgcggcgacaatcagctgcaggtgcagcacacgtactttacgggcagcgaggtggagaacgtgtcggtcaacgtgcacaaccccacgggccgaagcatctgccccagccaagagcccatgtcgatctatgtgtacgcgctgccgctcaagatgctgaacatccccagcatcaacgtgcaccactacccgtcggcggccgagcgcaaacaccgacacctgcccgtagccgacgctgttattcacgcgtcgggcaagcagatgtggcaggcgcgtctcacggtctcgggactggcctggacgcgtcagcagaaccagtggaaagagcccgacgtctactacacgtcagcgttcgtgtttcccaccaaggacgtggcactgcggcacgtggtgtgcgcgcacgagctggtttgctccatggagaacacgcgcgcaaccaagatgcaggtgataggtgaccagtacgtcaaggtgtacctggagtccttctgcgaggacgtgccctccggcaagctctttatgcacgtcacgctgggctctgacgtggaagaggacctaacgatgacccgcaacccgcaacccttcatgcgcccccacgagcgcaacggctttacggtgttgtgtcccaaaaatatgataatcaaaccgggcaagatctcgcacatcatgctggatgtggcttttacctcacacgagcattttgggctgctgtgtcccaagagcatcccgggcctgagcatctcaggtaacctgttgatgaacgggcagcaaatcttcctggaggtacaagcgatacgcgagaccgtggaactgcgtcagtacgatcccgtggctgcgctcttctttttcgatatcgacttgttgctgcagcgcgggcctcagtacagcgagcaccccaccttcaccagccagtatcgcatccagggcaagcttgagtaccgacacacctgggaccggcacgacgagggtgccgcccagggcgacgacgacgtctggaccagcggatcggactccgacgaagaactcgtaaccaccgagcgtaagacgccccgcgtcaccggcggcggcgccatggcgagcgcctccacttccgcgggccgcaaacgcaaatcagcatcctcggcgacggcgtgcacggcgggcgttatgacacgcggccgccttaaggccgagtccaccgtcgcgcccgaagaggacaccgacgaggattccgacaacgaaatccacaatccggccgtgttcacctggccgccctggcaggccggcatcctggcccgcaacctggtgcccatggtggctacggttcagggtcagaatctgaagtaccaggagttcttctgggacgccaacgacatctaccgcatcttcgccgaattggaaggcgtatggcagcccgctgcgcaacccaaacgtcgccgccaccggcaagacgccttgcccgggccatgcatcgcctcgacgcccaaaaagcaccgaggtgagtcctctgccaagagaaagatggaccctgataatcctgacgagggcccttcctccaaggtgccacggcccgagacacccgtgaccaaggccacgacgttcctgcagactatgttaaggaaggaggttaacagtcagctgagcctgggagacccgctgttcccagaattggccgaagaatccctcaaaacctttgaacaagtgaccgaggattgcaacgagaaccccgaaaaagatgtcctgacagaactcgtcaaacagattaaggttcgagtggacatggtgcggcatagaatcaaggagcacatgctgaaaaaatatacccagacggaagaaaaattcactggcgcctttaatatgatgggaggatgtttgcagaatgccttagatatcttagataaggttcatgagcctttcgaggacatgaagtgtattgggctaactatgcagagcatgtatgagaactacattgtacctgaggataagcgggagatgtggatggcttgtattaaggagctgcatgatgtgagcaagggcgccgctaacaagttggggggtgcactgcaggctaaggcccgtgctaaaaaggatgaacttaggagaaagatgatgtatatgtgctacaggaatatagagttctttaccaagaactcagccttccctaagaccaccaatggctgcagtcaggccatggcggcattgcagaacttgcctcagtgctctcctgatgagattatgtcttatgcccagaaaatctttaagattttggatgaggagagagacaaggtgctcacgcacattgatcacatatttatggatatcctcactacatgtgtggaaacaatgtgtaatgagtacaaggtcactagtgacgcttgtatgatgaccatgtacgggggcatctctctcttaagtgagttctgtcgggtgctgtgctgctatgtcttagaggagactagtgtgatgctggccaagcggcctctgataaccaagcctgaggttatcagtgtaatgaagcgccgcattgaggagatctgcatgaaggtctttgcccagtacattctgggggccgatcctttgagagtctgctctcctagtgtggatgacctacgggccatcgccgaggagtcagatgaggaagaggctattgtagcctacactttggccaccgctggtgccagctcctctgattctctggtgtcacctccagagtcccctgtacccgcgactatccctctgtcctcagtaattgtggctgagaacagtgatcaggaagaaagtgaacagagtgatgaggaacaggaggagggtgctcaggaggagcgggaggacactgtgtctgtcaagtctgagccagtgtctgagatagaggaagttgcctcagaggaagaggaggatggtgctgaggaacccaccgcctctggaggcaagagcacccaccctatggtgactagaagcaaggctgaccaggattacaaggacgatgacgataagtgataataggctggagcctcggtggccatgcttcttgccccttgggcctccccccagcccctcctccccttcctgcacccgtacccccgtggtctttgaataaagtctgagtgggcggc

SEQ ID NO: 252 - DNA, 3352 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgccgcgccaagaggagcggaagcggagctactaacttcagcctgctgaagcaggctggagacgtggaggagaaccctggacctatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgctgataataggctggagcctcggtggccatgcttcttgccccttgggcctccccccagcccctcctccccttcctgcacccgtacccccgtggtctttgaataaagtctgagtgggcggc

SEQ ID NO: 253 - DNA, 1924 bp, Artificial Sequence
  Synthetic polypeptide
tcaagcttttggaccctcgtacagaagctaatacgactcactatagggaaataagagagaaaagaagagtaagaagaaatataagagccaccatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagcgcgccaagaggagcggaagcggagctactaacttcagcctgctgaagcaggctggagacgtggaggagaaccctggacctatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttcgcgccaagaggagcggaagcggagtgaaacagactttgaattttgaccttctcaagttggcgggagacgtggagtccaaccctggacctatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 254 - DNA, 5146 bp, Artificial Sequence
  Synthetic polypeptide
tcaagcttttggaccctcgtacagaagctaatacgactcactatagggaaataagagagaaaagaagagtaagaagaaatataagagccaccatgcggccaggcctcccctcctacctcatcatcctcgccgtctgtctcttcagccacctactttcgtcacgatatggcgcagaagccgtatccgaaccgctggacaaagcgtttcacctactgctcaacacctacgggagacccatccgcttcctgcgtgaaaataccacccagtgtacctacaacagcagcctccgtaacagcacggtcgtcagggaaaacgccatcagtttcaactttttccaaagctataatcaatactatgtattccatatgcctcgatgtctttttgcgggtcctctggcggagcagtttctgaaccaggtagatctgaccgaaaccctggaaagataccaacagagacttaacacttacgcgctggtatccaaagacctggccagctaccgatctttttcgcagcagctaaaggcacaagacagcctaggtgaacagcccaccactgtgccaccgcccattgacctgtcaatacctcacgtttggatgccaccgcaaaccactccacacggctggacagaatcacataccacctcaggactacaccgaccacactttaaccagacctgtatcctctttgatggacacgatctactattcagcaccgtcacaccttgtttgcaccaaggcttttacctcatcgacgaactacgttacgttaaaataacactgaccgaggacttcttcgtagttacggtgtccatagacgacgacacacccatgctgcttatcttcggccatcttccacgcgtacttttcaaagcgccctatcaacgcgacaactttatactacgacaaactgaaaaacacgagctcctggtgctagttaagaaagatcaactgaaccgtcactcttatctcaaagacccggactttcttgacgccgcacttgacttcaactacctagacctcagcgcactactacgtaacagctttcaccgttacgccgtggatgtactcaagagcggtcgatgtcagatgctggaccgccgcacggtagaaatggccttcgcctacgcattagcactgttcgcagcagcccgacaagaagaggccggcgcccaagtctccgtcccacgggccctagaccgccaggccgcactcttacaaatacaagaatttatgatcacctgcctctcacaaacaccaccacgcaccacgttgctgctgtatcccacggccgtggacctggccaaacgagccctttggacaccgaatcagatcaccgacatcaccagcctcgtacgcctggtctacatactctctaaacagaatcagcaacatctcatcccccaatgggcactacgacagatcgccgactttgccctaaaactacacaaaacgcacctggcctcttttctttcagccttcgcacgccaagaactctacctcatgggcagcctcgtccactccatgctggtacatacgacggagagacgcgaaatcttcatcgtagaaacgggcctctgttcattggccgagctatcacactttacgcagttgttagctcatccacaccacgaatacctcagcgacctgtacacaccctgttccagtagcgggcgacgcgatcactcgctcgaacgcctcacgcgtctcttccccgatgccaccgtccccgctaccgttcccgccgccctctccatcctatctaccatgcaaccaagcacgctggaaaccttccccgacctgttttgcttgccgctcggcgaatccttctccgcgctgaccgtctccgaacacgtcagttatatcgtaacaaaccagtacctgatcaaaggtatctcctaccctgtctccaccaccgtcgtaggccagagcctcatcatcacccagacggacagtcaaactaaatgcgaactgacgcgcaacatgcataccacacacagcatcacagtggcgctcaacatttcgctagaaaactgcgccttttgccaaagcgccctgctagaatacgacgacacgcaaggcgtcatcaacatcatgtacatgcacgactcggacgacgtccttttcgccctggatccctacaacgaagtggtggtctcatctccgcgaactcactacctcatgcttttgaaaaacggtacggtactagaagtaactgacgtcgtcgtggacgccaccgacagtcgtctcctcatgatgtccgtctacgcgctatcggccatcatcggcatctatctgctctaccgcatgctcaagacatgccgcgccaagaggagcggaagcggagctactaacttcagcctgctgaagcaggctggagacgtggaggagaaccctggacctatgtgccgccgcccggattgcggcttctctttctcacctggaccggtgatactgctgtggtgttgccttctgctgcccattgtttcctcagccgccgtcagcgtcgctcctaccgccgccgagaaagtccccgcggagtgccccgaactaacgcgccgatgcttgttgggtgaggtgtttgagggtgacaagtatgaaagttggctgcgcccgttggtgaatgttaccgggcgcgatggcccgctatcgcaacttatccgttaccgtcccgttacgccggaggccgccaactccgtgctgttggacgaggctttcctggacactctggccctgctgtacaacaatccggatcaattgcgggccctgctgacgctgttgagctcggacacagcgccgcgctggatgacggtgatgcgcggctacagcgagtgcggcgatggctcgccggccgtgtacacgtgcgtggacgacctgtgccgcggctacgacctcacgcgactgtcatacgggcgcagcatcttcacggaacacgtgttaggcttcgagctggtgccaccgtctctctttaacgtggtggtggccatacgcaacgaagccacgcgtaccaaccgcgccgtgcgtctgcccgtgagcaccgctgccgcgcccgagggcatcacgctcttttacggcctgtacaacgcagtgaaggaattctgcctgcgtcaccagctggacccgccgctgctacgccacctagataaatactacgccggactgccgcccgagctgaagcagacgcgcgtcaacctgccggctcactcgcgctatggccctcaagcagtggatgctcgccgcgccaagaggagcggaagcggagtgaaacagactttgaattttgaccttctcaagttggcgggagacgtggagtccaaccctggacctatgagtcccaaagatctgacgccgttcttgacggcgttgtggctgctattgggtcacagccgcgtgccgcgggtgcgcgcagaagaatgttgcgaattcataaacgtcaaccacccgccggaacgctgttacgatttcaaaatgtgcaatcgcttcaccgtcgcgctgcggtgtccggacggcgaagtctgctacagtcccgagaaaacggctgagattcgcgggatcgtcaccaccatgacccattcattgacacgccaggtcgtacacaacaaactgacgagctgcaactacaatccgttatacctcgaagctgacgggcgaatacgctgcggcaaagtaaacgacaaggcgcagtacctgctgggcgccgctggcagcgttccctatcgatggatcaatctggaatacgacaagataacccggatcgtgggcctggatcagtacctggagagcgttaagaaacacaaacggctggatgtgtgccgcgctaaaatgggctatatgctgcagcgcgccaagaggagcggaagcggacagtgtactaattatgctctcttgaaattggctggagatgttgagagcaaccctggacctatgctgcggcttctgcttcgtcaccactttcactgcctgcttctgtgcgcggtttgggcaacgccctgtctggcgtctccgtggtcgacgctaacagcaaaccagaatccgtccccgccatggtctaaactgacgtattccaaaccgcatgacgcggcgacgttttactgtccttttctctatccctcgcccccacgatcccccttgcaattctcggggttccagcgggtatcaacgggtcccgagtgtcgcaacgagaccctgtatctgctgtacaaccgggaaggccagaccttggtggagagaagctccacctgggtgaaaaaggtgatctggtacctgagcggtcggaaccaaaccatcctccaacggatgccccgaacggcttcgaaaccgagcgacggaaacgtgcagatcagcgtggaagacgccaagatttttggagcgcacatggtgcccaagcagaccaagctgctacgcttcgtcgtcaacgatggcacacgttatcagatgtgtgtgatgaagctggagagctgggctcacgtcttccgggactacagcgtgtcttttcaggtgcgattgacgttcaccgaggccaataaccagacttacaccttctgcacccatcccaatctcatcgttcgcgccaagaggagcggaagcggagagggcagaggaagtctgctaacatgcggtgacgtcgaggagaatcctggacctatgcggctgtgtcgggtgtggctgtctgtttgtctgtgcgccgtggtgctgggtcagtgccagcgggaaaccgcggaaaaaaacgattattaccgagtaccgcattactgggacgcgtgctctcgcgcgctgcccgaccaaacccgttacaagtatgtggaacagctcgtggacctcacgttgaactaccactacgatgcgagccacggcttggacaactttgacgtgctcaagagaatcaacgtgaccgaggtgtcgttgctcatcagcgactttagacgtcagaaccgtcgcggcggcaccaacaaaaggaccacgttcaacgccgccggttcgctggcgccacacgcccggagcctcgagttcagcgtgcggctctttgccaactgataataggctggagcctcggtggccatgcttcttgccccttgggcctccccccagcccctcctccccttcctgcacccgtacccccgtggtctttgaataaagtctgagtgggcggc

SEQ ID NO: 255 - protein, 885 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 256 - DNA, 2655 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgcctacatccataccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacatggctgtatagagagacctgtaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagatgaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttggtgtgtggaccagcggagaaccctggaggtatttaaagaactgtctaagatcaacccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggacagtatgatcgcactggacattgaccctttggaaaacaccgattttcgcgtccttgagctgtactcccagaaagaactgcgctctagcaacgtctttgatcttgaggagatcatgagggagtttaactcttataaacagagggtgaagtatgtggaggataaagtggtcgaccctctgccaccctacctcaaaggactggacgatctgatgagcggacttggagctgccggcaaagccgtcggggtggctatcggtgccgtgggcggcgccgtggcttctgtggttgagggagtggccacttttcttaaaaatcctttcggagcttttaccattattctggtcgccatcgccgtggtgatcatcatttatctgatctacacccgccagcgccgcttgtgcatgcagccacttcagaacctgtttccctatctggtcagtgctgacggtacaaccgtgaccagcggcaacacaaaggacacaagccttcaggctcctccaagttatgaagagtccgtgtataattctgggaggaagggacctggtcccccctcttccgacgcctcaacagcggcacccccctacaccaatgagcaggcatatcagatgctcctggcccttgtgcggctcgatgccgagcaacgcgcacaacagaacgggacggattctctcgacggacagacaggcactcaggacaaaggccagaagcccaaccttctggatcggttgcggcatagaaaaaacggctatagacacctcaaggactcagacgaagaagagaacgtc

SEQ ID NO: 257 - protein, 885 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKCTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEACCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 258 - DNA, 2655 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgcctacatccataccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacatggctgtatagagagacctgtaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagtgcaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttgctgtgtggaccagcggagaaccctggaggtatttaaagaactgtctaagatcaacccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggacagtatgatcgcactggacattgaccctttggaaaacaccgattttcgcgtccttgagctgtactcccagaaagaactgcgctctagcaacgtctttgatcttgaggagatcatgagggagtttaactcttataaacagagggtgaagtatgtggaggataaagtggtcgaccctctgccaccctacctcaaaggactggacgatctgatgagcggacttggagctgccggcaaagccgtcggggtggctatcggtgccgtgggcggcgccgtggcttctgtggttgagggagtggccacttttcttaaaaatcctttcggagcttttaccattattctggtcgccatcgccgtggtgatcatcatttatctgatctacacccgccagcgccgcttgtgcatgcagccacttcagaacctgtttccctatctggtcagtgctgacggtacaaccgtgaccagcggcaacacaaaggacacaagccttcaggctcctccaagttatgaagagtccgtgtataattctgggaggaagggacctggtcccccctcttccgacgcctcaacagcggcacccccctacaccaatgagcaggcatatcagatgctcctggcccttgtgcggctcgatgccgagcaacgcgcacaacagaacgggacggattctctcgacggacagacaggcactcaggacaaaggccagaagcccaaccttctggatcggttgcggcatagaaaaaacggctatagacacctcaaggactcagacgaagaagagaacgtc

SEQ ID NO: 259 - protein, 885 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDCYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKICPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVDPLPPYLKGLDDLMSGLGAAGKAVGVAIGAVGGAVASVVEGVATFLKNPFGAFTIILVAIAVVIIIYLIYTRQRRLCMQPLQNLFPYLVSADGTTVTSGNTKDTSLQAPPSYEESVYNSGRKGPGPPSSDASTAAPPYTNEQAYQMLLALVRLDAEQRAQQNGTDSLDGQTGTQDKGQKPNLLDRLRHRKNGYRHLKDSDEEENV

SEQ ID NO: 260 - DNA, 2655 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgcctacatccataccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacatggctgtatagagagacctgtaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagatgaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttggtgtgtggaccagcggagaaccctggaggtatttaaagaactgtctaagatctgtccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggacagtatgatcgcactggacattgaccctttggaaaacaccgattttcgcgtccttgagctgtactcccagaaagaactgcgctctagcaacgtctttgatcttgaggagatctgtagggagtttaactcttataaacagagggtgaagtatgtggaggataaagtggtcgaccctctgccaccctacctcaaaggactggacgatctgatgagcggacttggagctgccggcaaagccgtcggggtggctatcggtgccgtgggcggcgccgtggcttctgtggttgagggagtggccacttttcttaaaaatcctttcggagcttttaccattattctggtcgccatcgccgtggtgatcatcatttatctgatctacacccgccagcgccgcttgtgcatgcagccacttcagaacctgtttccctatctggtcagtgctgacggtacaaccgtgaccagcggcaacacaaaggacacaagccttcaggctcctccaagttatgaagagtccgtgtataattctgggaggaagggacctggtcccccctcttccgacgcctcaacagcggcacccccctacaccaatgagcaggcatatcagatgctcctggcccttgtgcggctcgatgccgagcaacgcgcacaacagaacgggacggattctctcgacggacagacaggcactcaggacaaaggccagaagcccaaccttctggatcggttgcggcatagaaaaaacggctatagacacctcaaggactcagacgaagaagagaacgtc

SEQ ID NO: 261 - protein, 704 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAGHRTTYLLGSNTEYVAPPMWEIHHINSHSQCYSSYSRVIAGTVFVAYHRDSYENKTMQLMPDCYSNTHSTRYVTVKDQWHSRGSTALYRETSNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKCTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEACCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVKIEEILSKQYHIENEIARIKKLIG

SEQ ID NO: 262 - DNA, 2112 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgccggtcatcgtaccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacagcactgtatagagagacctctaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagtgcaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttgctgtgtggaccagcggagaaccctggaggtatttaaagaactgtctaagatcaacccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggacagtatgatcgcactggacattgaccctttggaaaacaccgattttcgcgtccttgagctgtactcccagaaagaactgcgctctagcaacgtctttgatcttgaggagatcatgagggagtttaactcttataaacagagggtgaagtatgtggaggataaagtggtcaagatcgaggagatcctgtccaagcagtaccacatcgagaacgagatcgcccgcatcaagaagctgatcggc

SEQ ID NO: 263 - protein, 704 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAGHRTTYLLGSNTEYVAPPMWEIHHINSHSQCYSSYSRVIAGTVFVAYHRDSYENKTMQLMPDCYSNTHSTRYVTVKDQWHSRGSTALYRETSNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKICPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVDSMIALDIDPLENTDFRVLELYSQKELRSSNVFDLEEICREFNSYKQRVKYVEDKVVKIEEILSKQYHIENEIARIKKLIG

SEQ ID NO: 264 - DNA, 2112 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgccggtcatcgtaccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacagcactgtatagagagacctctaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagatgaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttggtgtgtggaccagcggagaaccctggaggtatttaaagaactgtctaagatctgtccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggacagtatgatcgcactggacattgaccctttggaaaacaccgattttcgcgtccttgagctgtactcccagaaagaactgcgctctagcaacgtctttgatcttgaggagatctgtagggagtttaactcttataaacagagggtgaagtatgtggaggataaagtggtcaagatcgaggagatcctgtccaagcagtaccacatcgagaacgagatcgcccgcatcaagaagctgatcggc

SEQ ID NO: 265 - protein, 624 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAGHRTTYLLGSNTEYVAPPMWEIHHINSHSQCYSSYSRVIAGTVFVAYHRDSYENKTMQLMPDCYSNTHSTRYVTVKDQWHSRGSTALYRETSNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKCTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEACCVDQRRTLEVFKELSKINPSAILSAIYNKPIAARFMGDVLGLASCVTINQTSVKVLRDMNVKESPGRCYSRPVVIFNFANSSCVQYGQLGEDNEILLGNHRTEECQLPSLKIFIAGNSAYEYVDYLFKRMIDLSSISTVD

SEQ ID NO: 266 - DNA, 1872 bp, Artificial Sequence
  Synthetic nucleotide sequence
gtatcctccagctctactagaggaacgagcgcgacccattcacaccacagctcccacactacgagcgctgcccattctaggagtggctccgtgtcacaacgcgttactagtagccagaccgtgtctcacggcgtcaacgagacaatttacaacacgacgctgaaatacggcgatgtcgtgggtgtgaatactaccaagtacccctatagagtctgtagcatggcccagggcaccgacctgatcaggttcgaacggaacatcgtttgcacatcaatgaagcctatcaacgaagaccttgacgaggggattatggtggtatacaaacggaatatcgtggctcacaccttcaaagtgcgagtgtatcagaaggttctgacattccgaagaagttacgccggtcatcgtaccacctatctgctgggctccaacactgagtacgtggcgcccccaatgtgggaaatccaccacatcaacagccattcacagtgctactcttcctacagcagggtgattgcgggcacagtgtttgtggcctaccacagggacagctatgagaacaagacgatgcagttgatgccagattgttacagtaacactcacagtacacggtatgttacagttaaggatcagtggcattcacgcggaagcacagcactgtatagagagacctctaatttgaattgtatggtaactatcactactgcacggagcaagtacccttatcatttctttgctacaagcacgggcgatgtggtagacatcagccccttctataatggcacaaatcggaacgcaagctatttcggggagaacgccgacaagtttttcatttttcctaattatactattgtttctgacttcgggagacccaactccgccctggaaactcacagactggttgcgttcctcgaaagagcagattctgtgatatcctgggacattcaggatgaaaagaacgtcacgtgtcagctgaccttctgggaggcctcagagcggacgatccggtctgaggccgaggactcttaccactttagcagcgccaagtgcaccgcaaccttcctgtctaaaaaacaggaagtgaacatgtccgattctgctttggactgcgttcgcgatgaggccatcaacaagcttcaacaaattttcaatacctcctacaatcagacatatgaaaaatacggaaacgtgagtgtctttgaaaccaccgggggcctggtcgtgttctggcagggtatcaaacagaagagcctggtggaactggaacgcctggccaacagaagcagtttgaacctcacgcacaaccggacaaagaggagcaccgacggaaacaatgctacacacctttccaacatggagtctgtccacaatctggtttatgcacagcttcagttcacttatgacacactgcggggctacataaacagggctctggcacagatagccgaggcttgctgtgtggaccagcggagaaccctggaggtatttaaagaactgtctaagatcaacccctctgcgattctgagcgctatttacaacaaacccattgccgcacgcttcatgggggacgtcctcggtcttgcctcctgtgtgacaattaaccagacgagcgtgaaggtgctgcgagatatgaacgtgaaggaatcccctgggcggtgttacagtaggcctgtggtgattttcaacttcgccaactcttcctgtgtccaatacggtcaactcggtgaagataacgagattctgctgggcaatcatcggacagaagaatgccagttgccaagccttaaaatctttattgcaggaaattcagcctacgagtacgtcgactatctgtttaaaagaatgattgatctgagcagcatttccactgtggac

SEQ ID NO: 267 - protein, 685 aa, Artificial Sequence
  Synthetic peptide sequence
VSSSSTRGTSATHSHHSSHTTSAAHSRSGSVSQRVTSSQTVSHGVNETIYNTTLKYGDVVGVNTTKYPYRVCSMAQGTDLIRFERNIVCTSMKPINEDLDEGIMVVYKRNIVAHTFKVRVYQKVLTFRRSYAYIHTTYLLGSNTEYVAPPMWEIHHINSHSQCYSSYSRVIAGTVFVAYHRDSYENKTMQLMPDDYSNTHSTRYVTVKDQWHSRGSTWLYRETCNLNCMVTITTARSKYPYHFFATSTGDVVDISPFYNGTNRNASYFGENADKFFIFPNYTIVSDFGRPNSALETHRLVAFLERADSVISWDIQDEKNVTCQLTFWEASERTIRSEAEDSYHFSSAKMTATFLSKKQEVNMSDSALDCVRDEAINKLQQIFNTSYNQTYEKYGNVSVFETTGGLVVFWQGIKQKSLVELERLANRSSLNLTHNRTKRSTDGNNATHLSNMESVHNLVYAQLQFTYDTLRGYINRALAQIAEAWCVDQRRTLEVFKELSKINPSAILSAIYNKPIAARFMGDVLGLASCVTINQTSVKVLRDMNVKESPGRCYSRPVVIFNFANSSYVQYGQLGEDNEILLGNHRTEECQLPSLKIFIAGNSAYEYVDYLFKRMIDLSSISTVDSMIALDIDPLENTDFRVLELYSQKELRSSNVFDLEEIMREFNSYKQRVKYVEDKVVDPLPP

SEQ ID NO: 268 - protein, 22 aa, Artificial Sequence
  Synthetic peptide sequence
MESRIWCLVVCVNLCIVCLGAA

SEQ ID NO: 269 - protein, 24 aa, Artificial Sequence
  Synthetic peptide sequence
KIEEILSKQYHIENEIARIKKLIG

SEQ ID NO: 270 - DNA, 72 bp, Artificial Sequence
  Synthetic nucleotide sequence
aagatcgaggagatcctgtccaagcagtaccacatcgagaacgagatcgcccgcatcaagaagctgatcggc

SEQ ID NO: 271 - protein, 27 aa, Artificial Sequence
  Synthetic peptide sequence
GYIPEAPRDGQAYVRKDGEWVLLSTFL

SEQ ID NO: 272 - protein, 31 aa, Artificial Sequence
  Synthetic peptide sequence
RIKQIEDKIEEILSKQYHIENEIARIKKLIG

SEQ ID NO: 273 - protein, 17 aa, Artificial Sequence
  Synthetic peptide sequence
KIYHIENEIARIKKLIG

SEQ ID NO: 274 - protein, 32 aa, Artificial Sequence
  Synthetic peptide sequence
LSAIGGYIPEAPRDGQAYVRKDGEWVLLSTFL

The invention claimed is:

1. An engineered mutant of a wild-type cytomegalovirus (CMV) glycoprotein B (gB) protein, wherein said mutant comprises at least two amino acid mutations, and wherein said at least two amino acid mutations comprise at least one engineered disulfide mutation selected from the group consisting of: D217C and Y589C; M371C and W506C; and N524C and M684C; and wherein the numbering of the engineered mutations is relative to SEQ ID NO:1 numbering.

2. The mutant according to claim 1, wherein the amino acid mutations comprise a combination of at least two engineered disulfide mutations and at least one additional mutation.

3. The mutant according to claim 1, which is in the form of a trimer.

4. The mutant according to claim 1, which has increased stability in prefusion form as compared with the wild-type CMV gB protein, wherein the stability is measured by binding of a prefusion-specific antibody, thermal shift assay or EM imaging.

5. The mutant according to claim 1, wherein the wild-type CMV gB sequence is from the Towne strain.

6. The mutant according to claim 1, wherein said gB comprises an additional mutation selected from the group consisting of: (1) substitution of YIH at positions 155-157 with GHR; (2) substitution of W at position 240 with A; (3) substitution of C at position 246 with S; (4) substitution of P at position 655 with S; (5) substitution of F at position 678 with S; (6) substitution of L at position 680 with T; (7) substitution of R at position 685 with A; (8) substitution of MIALDI at positions 648-653 with GSGKDG; (9) substitution of R at position 693 with V; (10) substitution of I at position 675 with S; (11) substitution of I at positions 767 and 768 with C; (12) substitution of D at position 703 and P at position 704 with C; and (13) substitution of Y at position 696 and V at position 697 with C.

7. The mutant according to claim 1, wherein said gB comprises at least one additional mutation, and wherein the additional mutation is selected from the group consisting of: (1) substitution of YIH at positions 155-157 with GHR; (2) substitution of W at position 240 with A; (3) substitution of C at position 246 with S; (4) substitution of P at position 655 with S; (5) substitution of F at position 678 with S; (6) substitution of L at position 680 with T; (7) substitution of R at position 685 with A; (8) substitution of MIALDI at positions 648-653 with GSGKDG; (9) substitution of R at position 693 with V; (10) substitution of I at position 675 with S; (11) substitution of I at positions 767 and 768 with C; (12) substitution of D at position 703 and P at position 704 with C; and (13) substitution of Y at position 696 and V at position 697 with C.

8. The mutant according to claim 1, wherein the amino acid sequence of the mutant does not comprise a signal sequence (residues 1-22 of SEQ ID NO: 1).

9. The mutant of claim 1, wherein the amino acid sequence of the mutant does not comprise a membrane-proximal region (MPR) (residues 705-750 of SEQ ID NO: 1), transmembrane (TM) domain (residues 751-772 of SEQ ID NO: 1) or cytoplasmic (CT) domain domain (residues 773-907 of SEQ ID NO: 1).

10. The mutant of claim 1, wherein the amino acid sequence of the mutant comprises a truncated Domain V region.

11. The mutant of claim 1, wherein the amino acid sequence of the mutant does not comprise a Domain V region (residues 649-707 of SEQ ID NO: 1).

12. The mutant of claim 1, wherein the mutant further comprises a trimerization motif linked to the C terminus of the mutant.

13. The mutant of claim 12, wherein the trimerization motif is selected from the group consisting of:
(i) an inter-protomer disulfide ring;
(ii) GCN4;
(iii) T4 fibritin foldon; and
(iv) C-terminus fusion sequence.

14. The mutant of claim 1, wherein the wildtype CMV gB polypeptide sequence is selected from SEQ ID NOs: 1, 107-140, or 224.

15. The mutant of claim 1, wherein the wildtype CMV gB polypeptide sequence is encoded by the polynucleotide sequences set forth in SEQ ID NOs: 225-254.

16. A nucleic acid molecule comprising a nucleotide sequence that encodes an amino acid sequence of a CMV gB protein mutant according to claim 1.

17. A pharmaceutical composition comprising (i) a CMV gB protein mutant according to claim 1 and (ii) a pharmaceutically acceptable carrier.

18. The pharmaceutical composition according to claim 17, which is a vaccine.

19. A method of reducing CMV infection in a subject comprising administering to the subject an effective amount of the vaccine according to claim 18.

20. A method of eliciting an immune response to CMV infection in a subject comprising administering to the subject an effective amount of the vaccine according to claim 18.

21. A method of inhibiting CMV infection in a subject comprising administering to the subject an effective amount of the vaccine according to claim 18.

22. The mutant according to claim 7, wherein said gB comprises an additional mutation selected from the group consisting of: (1) substitution of YIH at positions 155-157 with GHR; (2) substitution of W at position 240 with A; (3) substitution of C at position 246 with S; and (4) substitution of I at position 675 with S.

23. The mutant according to claim 7, wherein the amino acid mutations are a combination of mutations selected from the group consisting of:
(1) combination of D217C and Y589C, M371C and W506C, and 1675S;
(2) combination of D217C and Y589C, N524C and M684C, and 1675S;
(3) combination of D217C and Y589C, M371C and W506C, Y155G I156H H157R, W240A, C246S and 1675S; and
(4) combination of D217C and Y589C, N524C and M684C, Y155G I156H H157R, W240A, C246S and 1675S.

24. The mutant according to claim 1, wherein the mutant comprises a cysteine (C) at position 217 (217C) and at position 589 (589C), a cysteine (C) at position 371 (371C) and at position 506 (506C), and a serine (S) at position 675 (675S), and wherein the mutant is selected from the group consisting of:
(1) a mutant comprising the amino acid sequence set forth in SEQ ID NO:257; and
(2) a mutant comprising an amino acid sequence that is at least 97%, 98% or 99% identical to the amino acid sequence of SEQ ID NO:257.

25. The mutant according to claim 1, wherein the mutant comprises a cysteine (C) at position 217 (217C) and at position 589 (589C), a cysteine (C) at position 524 (524C) and at position 684 (684C), and a serine (S) at position 675 (675S), and wherein the mutant is selected from the group consisting of:
(1) a mutant comprising the amino acid sequence of SEQ ID NO: 259; and
(2) a mutant comprising an amino acid sequence that is at least 97%, 98% or 99% identical to the amino acid sequence of SEQ ID NO: 259.

26. The mutant according to claim 1, wherein the mutant comprises a cysteine (C) at position 217 (217C) and at position 589 (589C), a cysteine (C) at position 371 (371C) and at position 506 (506C), a serine (S) at position 675 (675S), a glycine (G) at position 155 (155G), a histidine at position 156 (156H), an arginine at position 157 (157R), an alanine at position 240 (240A), and a serine at position 246 (246S), and wherein the mutant is selected from the group consisting of:
(1) a mutant comprising the amino acid sequence set forth in SEQ ID NO:261; and
(2) a mutant comprising an amino acid sequence that is at least 97%, 98% or 99% identical to the amino acid sequence of SEQ ID NO: 261.

27. The mutant according to claim 1, wherein the mutant comprises a cysteine (C) at position 217 (217C) and at position 589 (589C), a cysteine (C) at position 524 (524C) and at position 684 (684C), a serine (S) at position 675 (675S), a glycine (G) at position 155 (155G), a histidine at position 156 (156H), an arginine at position 157 (157R), an alanine at position 240 (240A), and a serine at position 246 (246S), and wherein the mutant is selected from the group consisting of:
(1) a mutant comprising the amino acid sequence of SEQ ID NO: 263; and
(2) a mutant comprising an amino acid sequence that is at least 97%, 98% or 99% identical to the amino acid sequence of SEQ ID NO:263.

28. The mutant of claim 13, wherein
(i) the GCN4 comprises an amino acid sequence as set forth in SEQ ID NOs: 269, 272 or 273;
(ii) the T4 fibritin foldon comprises an amino acid sequence as set forth in SEQ ID NO: 271; or
(iii) the C-terminus fusion sequence comprises an amino acid sequence as set forth in SEQ ID NO: 274.

29. The mutant of claim 13, wherein the inter-protomer disulfide ring comprises at least two engineered cysteine mutations selected from:
(i) 696C and 697C;
(ii) 703C and 704C; or
(iii) 767C and 768C.

30. The mutant of claim 1, wherein the mutant is secreted.

31. The mutant of claim 1, wherein the mutant is soluble.

32. The nucleic acid molecule of claim 16, wherein the nucleic acid comprises nucleotides having a sequence set forth in SEQ ID NOs: 225-254 or 266.

33. A method of preventing a disease associated with a CMV infection in a subject comprising administering to the subject an effective amount of the vaccine according to claim 18.

34. The mutant of claim 10, wherein the truncated Domain V ends at residue 702 or 703 of SEQ ID NO: 1.

35. The mutant of claim 11, wherein the amino acid sequence of the mutant does not comprise a signal sequence (residues 1-22 of SEQ ID NO: 1).

36. The mutant of claim 1, wherein the mutant comprises an amino acid sequence that is at least 97%, 98% or 99% identical to the amino acid sequence of SEQ ID NO:265.

37. The mutant of claim 1, wherein the mutant comprises the amino acid sequence set forth in SEQ ID NO: 265.

* * * * *